US009700071B2

(12) United States Patent
Silver et al.

(10) Patent No.: US 9,700,071 B2
(45) Date of Patent: *Jul. 11, 2017

(54) NUTRITIVE FRAGMENTS, PROTEINS AND METHODS

(71) Applicant: Pronutria, Inc., Cambridge, MA (US)

(72) Inventors: Nathaniel W. Silver, Cambridge, MA (US); Geoffrey von Maltzahn, Boston, MA (US); Michael J. Hamill, Wellesley, MA (US); David Arthur Berry, Brookline, MA (US)

(73) Assignee: Axcella Health Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/387,684

(22) PCT Filed: Mar. 15, 2013

(86) PCT No.: PCT/US2013/032180
§ 371 (c)(1),
(2) Date: Sep. 24, 2014

(87) PCT Pub. No.: WO2013/148325
PCT Pub. Date: Oct. 3, 2013

(65) Prior Publication Data
US 2015/0080296 A1    Mar. 19, 2015

Related U.S. Application Data

(60) Provisional application No. 61/615,819, filed on Mar. 26, 2012, provisional application No. 61/728,685, filed on Nov. 20, 2012.

(51) Int. Cl.
| | |
|---|---|
| A23J 3/04 | (2006.01) |
| C12P 21/02 | (2006.01) |
| A61K 38/02 | (2006.01) |
| A23L 1/29 | (2006.01) |
| C12N 15/70 | (2006.01) |
| A61K 38/16 | (2006.01) |
| C07K 2/00 | (2006.01) |
| C07K 14/00 | (2006.01) |
| A23L 33/00 | (2016.01) |
| A23L 33/17 | (2016.01) |
| A23L 33/18 | (2016.01) |

(52) U.S. Cl.
CPC ............ *A23L 1/293* (2013.01); *A23J 3/04* (2013.01); *A23L 33/17* (2016.08); *A23L 33/18* (2016.08); *A23L 33/30* (2016.08); *A61K 38/02* (2013.01); *A61K 38/16* (2013.01); *C07K 2/00* (2013.01); *C07K 14/00* (2013.01); *C12N 15/70* (2013.01); *C12P 21/02* (2013.01); *A23V 2002/00* (2013.01)

(58) Field of Classification Search
None
See application file for complete search history.

(56) References Cited

U.S. PATENT DOCUMENTS

| | | | |
|---|---|---|---|
| 3,870,801 | A | 3/1975 | Tombs |
| 4,016,147 | A | 4/1977 | Fujimaki et al. |
| 4,601,980 | A | 7/1986 | Goededel et al. |
| 4,687,782 | A | 8/1987 | Brantman |
| 5,736,187 | A | 4/1998 | Tesmer et al. |
| 5,866,338 | A | 2/1999 | Hartwell et al. |
| 6,004,930 | A | 12/1999 | Hainline |
| 6,291,245 | B1 | 9/2001 | Kopetzki et al. |
| 6,361,966 | B1 | 3/2002 | Walker et al. |
| 6,495,344 | B1 | 12/2002 | Carr |
| 6,630,320 | B1 | 10/2003 | Davis et al. |
| 7,211,431 | B2 | 5/2007 | Rao et al. |
| 7,214,786 | B2 | 5/2007 | Kovalic |
| 7,252,972 | B2 | 8/2007 | Kikuchi et al. |
| 7,314,974 | B2 | 1/2008 | Cao et al. |
| 7,790,688 | B2 | 9/2010 | Wolfe et al. |
| 8,071,122 | B2 | 12/2011 | Yamka et al. |
| 8,329,646 | B2 | 12/2012 | Tisdale et al. |
| 8,343,747 | B2 | 1/2013 | Burke et al. |
| 8,409,840 | B2 | 4/2013 | Muller et al. |
| 8,426,184 | B2 | 4/2013 | Blum et al. |
| 8,486,888 | B2 | 7/2013 | Greenberg |
| 8,546,118 | B2 | 10/2013 | Weiner et al. |
| 8,618,047 | B2 | 12/2013 | Hofman et al. |
| 8,735,107 | B2 | 5/2014 | Weiner et al. |
| 8,809,259 | B2 * | 8/2014 | Berry ............ A23J 3/04 426/2 |
| 8,815,806 | B2 | 8/2014 | Aluko et al. |
| 8,822,412 | B2 * | 9/2014 | Berry ............ A23J 3/04 426/2 |
| 8,877,281 | B2 | 11/2014 | Segall et al. |
| 9,364,463 | B2 | 6/2016 | Ferrando et al. |
| 2004/0071825 | A1 | 4/2004 | Lockwood |
| 2004/0123343 | A1 | 6/2004 | La Rosa et al. |
| 2004/0266689 | A1 | 12/2004 | McMichael et al. |
| 2005/0010973 | A1 | 1/2005 | Rao et al. |
| 2006/0150283 | A1 * | 7/2006 | Alexandrov ...... C07K 14/415 800/288 |

(Continued)

FOREIGN PATENT DOCUMENTS

| | | |
|---|---|---|
| CN | 101886107 A | 11/2010 |
| EP | 0347890 B1 | 3/1993 |

(Continued)

OTHER PUBLICATIONS

Grandjean et al., Essential nutrition for cats and dogs, 2009, 1-64.*

(Continued)

*Primary Examiner* — James H Alstrum Acevedo
*Assistant Examiner* — Roy Teller
(74) *Attorney, Agent, or Firm* — Fenwick & West LLP

(57) ABSTRACT

Nutritive proteins are provided. In some embodiments the nutritive proteins comprise a protein digestibility corrected amino acid score (PDCAAS) that exceeds a benchmark protein. Also provided are nucleic acids encoding the proteins, recombinant microorganisms that make the proteins, methods of making the proteins using recombinant microorganisms, compositions that comprise the proteins, and methods of using the proteins, among other things.

12 Claims, 19 Drawing Sheets

(56) References Cited

U.S. PATENT DOCUMENTS

| | | |
|---|---|---|
| 2006/0159724 A1 | 7/2006 | Bell |
| 2007/0264688 A1 | 11/2007 | Venter |
| 2008/0032000 A1 | 2/2008 | Schnorr et al. |
| 2008/0206430 A1 | 8/2008 | Avila |
| 2008/0268038 A1 | 10/2008 | Wolfe |
| 2008/0317725 A1 | 12/2008 | Baum |
| 2009/0181903 A1 | 7/2009 | Wolfe et al. |
| 2009/0197820 A1 | 8/2009 | Wolfe et al. |
| 2009/0203606 A1 | 8/2009 | Wolfe et al. |
| 2009/0252684 A1 | 10/2009 | Wolfe et al. |
| 2009/0304901 A1 | 12/2009 | Bobzin et al. |
| 2010/0055246 A1 | 3/2010 | Ahn |
| 2010/0179089 A1 | 7/2010 | Deutz et al. |
| 2010/0189864 A1 | 7/2010 | Marsland |
| 2010/0189865 A1 | 7/2010 | Sweet |
| 2010/0267831 A1 | 10/2010 | Kobayashi et al. |
| 2010/0286023 A1 | 11/2010 | Wolfe et al. |
| 2010/0317597 A1 | 12/2010 | Ney et al. |
| 2010/0330250 A1 | 12/2010 | Segall et al. |
| 2011/0183052 A1 | 7/2011 | Sherwood et al. |
| 2011/0250310 A1 | 10/2011 | Mateus et al. |
| 2011/0319596 A1 | 12/2011 | De La Torre-Montemayor |
| 2012/0046449 A1 | 2/2012 | Green et al. |
| 2012/0178672 A1 | 7/2012 | Wolfe et al. |
| 2013/0090297 A1 | 4/2013 | Troup et al. |
| 2013/0296231 A1 | 11/2013 | Berry et al. |
| 2014/0342978 A1 | 11/2014 | Berry et al. |
| 2014/0343148 A1 | 11/2014 | Kohsaka et al. |
| 2015/0011482 A1 | 1/2015 | Berry et al. |

FOREIGN PATENT DOCUMENTS

| | | |
|---|---|---|
| EP | 1552753 B1 | 7/2005 |
| EP | 1455603 B1 | 10/2006 |
| JP | 2015-503330 A | 2/2015 |
| JP | 2015-513904 A | 5/2015 |
| KR | 10-2010-0057630 A | 5/2010 |
| WO | WO 02/087562 A1 | 11/2002 |
| WO | WO 2004/052295 A2 | 6/2004 |
| WO | WO 2004/058988 A2 | 7/2004 |
| WO | WO 2006/047308 A2 | 5/2006 |
| WO | WO 2007/023172 A2 | 3/2007 |
| WO | WO 2007/053390 A2 | 5/2007 |
| WO | WO 2010/043415 A2 | 4/2010 |
| WO | WO 2010/126353 A1 | 11/2010 |
| WO | WO 2010/126362 A1 | 11/2010 |
| WO | WO 2010/144821 A1 | 12/2010 |
| WO | WO 2011/027188 A1 | 3/2011 |
| WO | WO 2011/078677 A2 | 6/2011 |
| WO | WO 2011/084978 A1 | 7/2011 |
| WO | WO 2011/119023 A1 | 9/2011 |
| WO | WO 2011/119033 A1 | 9/2011 |
| WO | WO 2012/005568 A1 | 1/2012 |
| WO | WO 2012/006074 A1 | 1/2012 |
| WO | WO 2013/148330 A1 | 10/2013 |
| WO | WO 2013/148331 A1 | 10/2013 |
| WO | WO 2014/134225 A2 | 9/2014 |

OTHER PUBLICATIONS

Barac, M. et al., "Profile and Functional Properties of Seed Proteins from Six Pea (*Pisum sativum*) Genotypes," Int. J. Mol. Sci., 2010, pp. 4973-4990, vol. 11.

Chinpongpanich, A. et al., "Biophysical Characterization of Calmodulin and Calmodulin-Like Proteins from Rice, *Oryza sativa* L.," Acta Biochim. Biophys. Sin., 2011, pp. 867-876, vol. 43.

Database EMBL Accession No. BX822075, Arabidopsis Thaliana Full-Length cDNA Complete Sequence from Clone GSLTSIL9ZH07 of Silique of Strain Col-0 of *Arabidopsis thaliana* (Thale Cress), Retrieved from EBI Accession No. EMBL:BX822075, Feb. 6, 2004, 2 pages.

Database UniProt Accession No. 022287, "RecName: Full=Mannose-1-phosphate Guanylyltransferase 1; EC=2.7.7.13; AltName: Full=GDP-mannose Pyrophosphorylase 1; AltName: Full=Protein Embryo Defective 101; AltName: Full=Protein Hypersensitive to Ammonium Ion 1; AltName: Full=Protein Sensitive to 0," Retrieved from EBI Accession No. UNIPROT:022287, Sep. 21, 2011, 3 pages.

European Extended Search Report, European Application No. 13770153.8, Oct. 30, 2015, 11 pages.

Hughes, G.J. et al., "Protein Digestibility-Corrected Amino Acid Scores (PDCAAS) for Soy Protein Isolates and Concentrate: Criteria for Evaluation," Journal of Agricultural and Food Chemistry, Dec. 14, 2011, pp. 12707-12712, vol. 59, No. 23.

Israel Office Action, Israel Patent Application No. 234617, Oct. 22, 2015, 3 pages (with concise explanation of relevance).

Israel Office Action, Israel Patent Application No. 234621, Oct. 22, 2015, 3 pages (with concise explanation of relevance).

Lee, J., "Soy Protein Hydrolysate; Solubility, Thermal Stability, Bioactivity, and Sensory Acceptability in a Tea Beverage," Master's Thesis, University of Minnesota, Aug. 2011, 131 pages.

Sang, J. et al., "Cross-Talk Between Calcium-Calmodulin and Nitric Oxide in Abscisic Acid Signaling in Leaves of Maize Plants," Cell Research, 2008, pp. 577-588, vol. 18.

Schaafsma, G., "Criteria and Significance of Dietary Protein Sources in Humans and the Protein Digestibility-Corrected Amino Acid Score 1," J. Nutr., Jul. 31, 2000, pp. 1865S-1867S, [Online] [Retrieved on Oct. 15, 2015] Retrieved from the Internet<URL: http://jn.nutrition.org/content/130/7/1865S.full.pdf+html>.

Singapore Office Action, Singapore Application No. 11201405842P, Nov. 17, 2015, 18 pages.

Tsunoda, Y. et al., "Improving Expression and Solubility of Rice Proteins Produced as Fusion Proteins in *Escherichia coli*," Protein Expr. Purif., Aug. 2005, pp. 268-277, vol. 42, No. 2.

United States Office Action, U.S. Appl. No. 14/337,563, Jun. 26, 2015, 11 pages.

United States Restriction Requirement, U.S. Appl. No. 14/374,127, May 5, 2015, 8 pages.

United States Restriction Requirement, U.S. Appl. No. 14/387,675, Jun. 25, 2015, 8 pages.

United States Restriction Requirement, U.S. Appl. No. 14/387,677, Jun. 25, 2015, 8 pages.

United States Restriction Requirement, U.S. Appl. No. 14/387,679, Sep. 22, 2015, 8 pages.

"Amino Acid Calculation Results," Jan. 1, 1995 [Online] [Retrieved Nov. 30, 2015] Retrieved from the Internet<URL:http://Proteome.gs.washington.edu/cgi-bin/aa_calc.pl>.

Beauregard, M. et al., "Design, Expression, and Initial Characterization of MB1, a De Novo Protein Enriched in Essential Amino Acids," Biotechnology, Sep. 1995, pp. 974-981, vol. 13, 1995 Nature Publishing Group, http://wwww.nature, Jan. 1, 1995, [Online] [Retrieved on Nov. 30, 2015] Retrieved from the Internet<URL:http://www.nature.com/nbt/journal/v13/n9/pdf/nbt0995-974.pdf>.

Database Geneseq: "Rice Glutaredoxin Homolog/Ortholog Protein SEQ ID: 146," Oct. 18, 2007, Retrieved from EBI Accession No. GSP:AGV35765, Database Accession No. AGV35765.

Database Uniprot: "RecName: Full=Glycosylation-Dependent Cell Adhesion Molecule 1; Short=GlyCAM-1; AltName:Full=Lactophorin; AltName: Full=Proteose-Peptone Component 3; Short=PP3; AltName: Full=Whey Protein; Flags: Precursor;" Apr. 1, 1990, Retrieved from EBI Accession No. UNIPROT:P15522.

European Extended Search Report, European Application No. 13770012.6, Dec. 9, 2015, 8 pages.

European Extended Search Report, European Application No. 13768128.4, Dec. 16, 2015, 10 pages.

European Extended Search Report, European Application No. 13767346.3, Dec. 22, 2015, 10 pages.

European Extended Search Report, European Application No. 13768270.4, Jan. 12, 2016, 10 pages.

Fernholm, R. et al., "Amino Acid Profiles in Adults with Growth Hormone (GH) Deficiency Before and During GH Replacement Therapy," Growth Hormone & IGF Research, 2009, pp. 206-2011, vol. 19.

(56) References Cited

OTHER PUBLICATIONS

Fong, Y. et al., "Recombinant Growth Hormone Enhances Muscle Myosin Heavy-Chain mRNA Accumulation and Amino Acid Accrual in Humans," Proc. Natl. Acad. Sci., May 1989, pp. 3371-3374, vol. 86.
Goda, S.K. et al., "Recombinant Expression Analysis of Natural and Synthetic Bovine Alpha-Casein in *Escherichia coli*," Applied Microbiology and Biotechnology, Nov. 14, 2000, pp. 671-676, vol. 54, No. 5.
Humantrope® Package Leaflet: Information for the User, Jan. 2011, 2 pages, [Online] May be Retrieved at<URL:https://www.google.hu/search?q=humatrope+lilly&espv=2&biw=1920&bih=911&source=lnt&tbs=cdr%3A1%2Ccd_min%3A%2Ccd_max%3A2012.03.25&tbm=#>.
Kobayashi, H. et al., "Modulations of Muscle Protein Metabolism by Branched-Chain Amino Acids in Normal and Muscle-Atrophying Rats," The Journal of Nutrition, American Society for Nutrition, Jan. 1, 2006, pp. 234S-236S, vol. 136, No. 1.
Magne, H. et al., "Contrarily to Whey and High Protein Diets, Dietary Free Leucine Supplementation Cannot Reverse the Lack of Recovery of Muscle Mass After Prolonged Immobilization During Ageing," The Journal of Physiology, Feb. 2012, pp. 2035-2049, vol. 590.8.
Oser, B.L., "Assessment of the Nutritional Value of Novel Proteins," Journal of the American Oil Chemists Society (JAOCS), Nov. 1970, pp. 453-457, vol. 47, No. 11.
"Protropin Drug Description," RxList, Aug. 12, 2004, 2 pages, [Online] May be Retrieved at<URL:http://www.rxlist.com/protropin-drug.htm>.
Rieu, I. et al., "Increased Availability of Leucine with Leucine-Rich Whey Proteins Improves Postprandial Muscle Protein Synthesis in Aging Rats," Nutrition, 2007, pp. 323-331, vol. 23.
Russian Office Action, Russian Application No. 2014143031/ (069502), Dec. 3, 2015, 14 pages.
Schein, C.H., "Solubility as a Function of Protein Structure and Solvent Components," Biotechnology, The International Monthly for Industrial Biology, Nature Publishing Group, Apr. 1990, pp. 308-317, vol. 8, No. 4.
Sindayikengera, S. et al., "Nutritional Evaluation of Caseins and Whey Proteins and Their Hydrolysates from Protamex," Journal of Zhejiang University Science B; an International Biomedicine & Biotechnology Journal, Feb. 2006, pp. 90-98, vol. 7, No. 2.
Singapore Office Action (including Search Report and Written Opinion), Singapore Application No. 11201405841R, Dec. 8, 2015, 22 pages.
United States Office Action, U.S. Appl. No. 14/337,563, Feb. 1, 2016, 13 pages.
Aalberse, R. C., "Structural biology of allergens", J. Allergy Clin. Immunol. 106, 228-238 (2000).
Abou-Samra, R. et al., "Effect of different protein sources on satiation and short-term satiety when consumed as a starter", Nutr J. 10:139 (Dec. 23, 2011).
Acheson, K. et al., "Protein choices targeting thermogenesis and metabolism", Am J Clin Nutr 93:525-34 (2011).
Akhavan, T. et al., "Effect of premeal consumption of whey protein and its hydrolysate on food intake and postmeal glycemia and insulin responses in young adults", Am J Clin Nutr. 91(4):966-75 (Apr. 2010) (Epub Feb. 17, 2010).
Alfenas, R. et al., "Effects of protein quality on appetite and energy metabolism in normal weight subjects", Arq Bras Endocrinol Metabol. 54 (1): 45-51; (2010).
Austin, B. P. et al., "Hexahistidine-tagged maltose-binding protein as a fusion partner for the production of soluble recombinant proteins in *Escherichia coli*", Methods Mol. Biol. 498:157-72 (2009).
Avruch, J. et al., "Amino acid regulation of TOR complex 1", Am J Physiol Endocrinol Metab. 296:E592-602. (2009).
Bai, J. et al., "A gene optimization strategy that enhances production of fully functional P-Glycoprotein in Pichia pastoris", PLoS ONE 6(8):e22577 (2011).
Belza, A. et al., "The beta-adrenergic antagonist propranolol partly abolishes thermogenic response to bioactive food ingredients", Metabolism. 58 (8):1137-44 (2009).
Borsheim, E. et al., "Effect of amino acid supplementation on muscle mass, strength and physical function in elderly", Clin Nutr. 27:189-195 (2008).
Borsheim, E. et al., "Essential amino acids and muscle protein recovery from resistance exercise", Am J Physiol Endocrinol Metab. 283: E648-E657 (2002).
Bossios, A. et al., "Effect of simulated gastro-duodenal digestion on the allergenic reactivity of beta-lactoglobulin", Clin Transl Allergy. 1:6. (2011).
Breen, L., Churchward-Venne T a., "Leucine: a nutrient "trigger" for muscle anabolism, but what more?" J Physiol. 590:2065-6. (2012).
Breen, L., Phillips SM., "Skeletal muscle protein metabolism in the elderly: Interventions to counteract the "anabolic resistance" of ageing", Nutr Metab. Lond. 8:68. (2011).
Brockerhoff, S.E. et al., "Structural Analysis of Wild-Type and Mutant Yeast Calmodulins by Limited Proteolysis and Electrospray Ionization Mass Spectrometry," Protein Science, 1992, pp. 504-516, vol. I.
Butts, C. et al., "In vitro determination of dietary protein and amino acid digestibility for humans", Br J Nutr;108 Suppl :S282-7. (2012).
Cheng, C.-H. et al., "Protein Solubility and Differential Proteomic Profiling of Recombinant *Escherichia coli* Overexpressing Double-Tagged Fusion Proteins," Microbial Cell Factories, Aug. 28, 2010, pp. 63-75, vol. 9.
Conti, A. et al., "Identification of the Human β-Casein C-Terminal Fragments That Specifically Bind to Purified Antibodies to Bovine β-Lactoglobulin," J. Nutr. Biochem., 2000, pp. 332-337, vol. 11.
Dauncey, M., Bingham S., "Dependence of 24 h energy expenditure in man on composition of the nutrient intake", Br J Nutr. 50:1-13 (1983).
De Baulny, H.O. et al., "Management of Phenylketonuria and Hyper- Phenylalaninemia," The Journal of Nutrition, Jun. 2007, pp. 1561S-1563S, vol. 137.
Delaney, B. et al., "Evaluation of protein safety in the context of agricultural biotechnology." Food. Chem. Toxicol. 46: S71-S97 (2008).
Deutz, N.E.P. et al., "Muscle protein synthesis in cancer patients can be stimulated with a specially formulated medical food", Clin Nutr. 30:759-68. (2011).
Dreyer, et al., "Leucine-enriched essential amino acid and carbohydrate ingestion following resistance exercise enhances mTOR signaling and protein synthesis in human muscle", Am. J. Physiol. Endocrinol. Metab. 294(2):E392-E400 (2008).
Dulloo, A., "The search for compounds that stimulate thermogenesis in obesity management: from pharmaceuticals to functional food ingredients." Obes Rev. 12: 866-83 (2011).
Eastoe, J. E., "The Amino Acid Composition of Mammalian Collagen and Gelatin", Biochem. J., vol. 61, pp. 589-600 (1955).
Elango, R. et al., "Available versus digestible amino acids—new stable isotope methods", Br J Nutr.108 Suppl:S306-14. (2012).
Esmarck, B. et al., "Timing of postexercise protein intake is important for muscle hypertrophy with resistance training in elderly humans", J Physiol. 535: 301-311. (2001).
Fernstrom, J.D., Wolfe R.R., "Introduction to Symposium on Branched-Chain Amino Acids in Exercise", J Nutr.136:5245. (2006).
Ferrando, A. et al., "EAA supplementation to increase nitrogen intake improves muscle function during bed rest in the elderly", Clin Nutr. 29:18-23. (2010).
Fromentin, G. et al., "Peripheral and central mechanisms involved in the control of food intake by dietary amino acids and proteins", Nutr Res Rev. 25: 29-39. (2012).
Fujita, et al., "Nutrient signaling in the regulation of human muscle protein synthesis", J. Physio. 582.2:813-23 (2007).
Golovanov, A.P. et al., "A Simple Method for Improving Protein Solubility and Long-Term Stability," Journal of the American Chemical Society, Jul. 28, 2004, pp. 8933-8939, vol. 126, No. 29.

(56) References Cited

OTHER PUBLICATIONS

Goodman, R. E. et al., "Allergenicity assessment of genetically modified crops—what makes sense?" Nature Biotechnology. pp. 73-81 (2008).
Gran, P., Cameron-Smith D., "The actions of exogenous leucine on mTOR signalling and amino acid transporters in human myotubes", BMC Physiol. 11:10. (2011).
Hall, W. L. et al., "Casein and whey exert different effects on plasma amino acid profiles, gastrointestinal hormone secretion and appetite", Br J Nutr. 89(2):239-48 (Feb. 2003).
Haran, P. H. et al., "Role and potential mechanisms of anabolic resistance in sarcopenia", J Cachexia Sarcopenia Muscle (2012).
Hayakawa, S. et al., "Relationships of Hydrophobicity and Net Charge to the Solubility of Milk and Soy Proteins," Journal of Food Science, Mar. 1985, pp. 486-491, vol. 50, No. 2.
Hefford, M.A., "Engineering Nutritious Proteins," Biotechnology and Genetic Engineering Reviews, Apr. 1997, pp. 191-210, vol. 14, No. 1.
Herman, R a. et al., "Digestion Assays in Allergenicity Assessment of Transgenic Proteins", Environ Health Perspect. 114:1154-7. (2006).
Holt, C. et al., "Some physico-chemical properties of nine commercial or semi-commercial whey protein concentrates, isolates and fractions", Int J Food Sci Technol. 34:587-601. (1999).
Holt, C. et al., "Apparent chemical composition of nine commercial or semi-commercial whey protein concentrates, isolates and fractions", Int J Food Sci Technol. 34:543-556. (1999).
Jenkins, J. A. et al., "Evolutionary distance from human homologs reflects allergenicity of animal food proteins", J. Allergy Clin Immunol. 120: 1399-1405 (2007).
Kalogeropoulou, D. et al., "Leucine, when ingested with glucose, synergistically stimulates insulin secretion and lowers blood glucose", Metabolism. 57:1747-52. (2008).
Katsanos, C. S. et al., "A high proportion of leucine is required for optimal stimulation of the rate of muscle protein synthesis by essential amino acids in the elderly", Am J Physiol Metab. 291:E381-7. (2006).
Kong, F., Singh R. P., "Disintegration of Solid Foods in Human Stomach," Journal of Food Science. pp. 67-80 (2008).
Koopman, et al., "Co-ingestion of leucine with protein does not further augment post-exercise muscle protein synthesis rates in elderly men", Br. J. Nutr. 99:571-80 (2008).
Koopman, et al., "Combined ingestion of protein and free leucine with carbohydrate increases postexercise muscle protein synthesis in vivo in male subjects", Am. J. Physiol. Endocrinol. Metab. 288:E645-643 (2005).
Kopf-Bolanz, K. A. et al., "Validation of an In Vitro Digestive System for Studying Macronutrient Decomposition" in 245-50. (2012).
Lands, L.C. et al.,"Effect of Supplementation with a Cysteine Donor on Muscular Performance," Journal of Applied Physiology, Oct. 1999, pp. 1381-1385, vol. 87, No. 4.
Lorenzen, J, et al. "The effect of milk proteins on appetite regulation and diet-induced thermogenesis", J Clin Nutr. 66 (5): 622-7. (2012).
Macauley-Patrick, S. et al., "Heterologous protein production using the Pichia pastoris expression system", Yeast. 22:249-70. (2005).
Macleod, E.L. et al., "Nutritional Management of Phenylketonuria," Annales Nestle, Jun. 2010, pp. 58-69, vol. 68, No. 2.
Malakhov, M. P.et al., "SUMO fusions and SUMO-specific protease for efficient expression and purification of proteins", J Struct Funct Genomics. 5(1-2):75-86 (2004).
Manders, et al., "Co-ingestion of a protein hydrolysate and amino acid mixture with carbohydrate improves plasma glucose disposal in patients with type 2 diabetes", Am. J. Clin. Nutr. 82(1):76-83 (2005).
Martos, G. et al., "Egg White Ovalbumin Digestion Mimicking Physiological Conditions." Journal of Agricultural and food chemistry. pp. 5640-5648 (2010).

Mikkelsen, P. et al., "Effect of fat-reduced diets on 24 h energy expenditure: comparisons between animal protein, vegetable protein and carbohydrate", Am J Clin Nutr. 72:1135-41 (2000).
Moore, D. et al., "Ingested protein dose response of muscle and albumin protein synthesis after resistance exercise in young men", Am J Clin Nutr. 89: 161-8. (2009).
Moreno, F. J. et al., "Phospholipid interactions protect the milk allergen a-Lactalbumin from proteolysis during in vitro digestion", Journal of agricultural and food chemistry. pp. 9810-9816 (2005).
Moreno, et al., "Stability of the major allergen Brazil nut 2S albumin (Ber e 1) to physiologically relevant in vitro gastrointestinal digestion", FEBS Journal. pp. 341-352. (2005).
Nicastro, H. et al., "An overview of the therapeutic effects of leucine supplementation on skeletal muscle under atrophic conditions", Amino Acids;40:287-300. (2011).
Norton, L. E. et al., "Leucine content of dietary proteins is a determinant of postprandial skeletal muscle protein synthesis in adult rats", Nutr Metab (Lond) 9:67. (2012).
Op Den Kamp, C. et al., "Muscle atrophy in cachexia: can dietary protein tip the balance?" Current Opinion in Clinical Nutrition and Metabolic Care. 12:611-616 (2009).
Paddon-Jones, et al., "Essential amino acid and carbohydrate supplementation ameliorates muscle protein loss in humans during 28 days bed rest", J Clin Endocrinol Metab; 89:4351-435 (2004).
Paddon-Jones, D. et al., "Nutritional Consequences of Critical Illness Myopathies Amino Acid Supplementation for Reversing Bed Rest and Steroid", J Nutr. 135:1809-12. (2005).
Panavas, T. et al., "SUMO fusion technology for enhanced protein production in prokaryotic and eukaryotic expression systems", Methods Mol Biol. 497:303-17. (2009).
Pasiakos, S. M., "Exercise and amino acid anabolic cell signaling and the regulation of skeletal muscle mass", Nutrients. 4:740-58. (2012).
PCT International Search Report, PCT Application No. PCT/US13/71091, May 2, 2014, 25 pages.
PCT International Search Report and Written Opinion, PCT Application No. PCT/US2013/032212, Jun. 28, 2013, 15 pages.
PCT International Search Report, PCT Application No. PCT/US2013/032180, Jun. 28, 2013, 14 pages.
PCT International Search Report, PCT Application No. PCT/US2013/032232, Jun. 26, 2013, 13 pages.
PCT International Search Report and Written Opinion, PCT Application No. PCT/US2013/032225, Jun. 26, 2013, 15 pages.
PCT International Search Report and Written Opinion, PCT Application No. PCT/US2013/032218, Jul. 22, 2013, 12 pages.
PCT International Search Report and Written Opinion, PCT Application No. PCT/US2013/032206, Jun. 26, 2013, 12 pages.
Poon, R. T-P. et al., "Long-term oral branched chain amino acids in patients undergoing chemoembolization for hepatocellular carcinoma: a randomized trial", Aliment Pharmacol Ther. 19:779-788. (2004).
Porro, D. et al., "Production of recombinant proteins and metabolites in yeasts: when are these systems better than bacterial production systems?" Appl Microbiol Biotechnol. 89:939-48. (2011).
Punt, P. J. et al., "Filamentous fungi as cell factories for heterologous protein production", Trends Biotechnol. 20:200-6. (2002).
Reddy, I. M. et al., "Structural and conformational Basis of the Resistance of b-Lactoglobulin to Peptic and Chymotryptic Digestion", J. Agric. Food Chem. vol. 36. pp. 737-741 (1988).
Saitoh, H. et al., "Strategies for the expression of Sumo-modified target proteins in *Escherichia coli*", Methods Mol. Biol. 497:211-21. (2009).
Sitkoff, D. et al., "Accurate Calculation of Hydration Free Energies Using Macroscopic Solvent Models", J. Phys. Chem. 98 (1994).
Sun, X., Zemel M. B., "Leucine and calcium regulate fat metabolism and energy partitioning in murine adipocytes and muscle cells", Lipids. 42:297-305. (2007).
Takio, K. et al., "Amino Acid Sequence of the βSubunit of Bovine Lung Casein Kinase II," Proc. Natl. Acad. Sci. USA, Jul. 1987, pp. 4851-4855, vol. 84.

(56) References Cited

OTHER PUBLICATIONS

Tang, J. E., Phillips S. M., "Maximizing muscle protein anabolism: the role of protein quality", Curr Opin Clin Nutr Metab Care. 12:66-71. (2009).
Tappy, L. et al., "Thermic effect of infused amino acids in healthy humans and in subjects with insulin resistance", Am J Clin Nutr. 57 (6): 912-6. (1993).
Tayek, J. A. et al., "Improved protein kinetics and albumin synthesis by branched chain amino acid-enriched total parenteral nutrition in cancer cachexia", Cancer. 58:147-57 (1986).
Thomas, K. et al., "Evaluating the effect of food processing on the potential human allergenicity of novel proteins: international workshop report.", Food Chem Toxicol. 45:1116-22. (2007).
Tipton, K. D. et al., "Stimulation of muscle anabolism by resistance exercise and ingestion of leucine plus protein", Appl Physiol Nutr Metab. 34:151-61. (2009).
Van Dijl, J. M., Hecker M., "Bacillus subtilis: from soil bacterium to super-secreting cell factory", Microb Cell Fact.12:3. (2013).
Veldhorst, M. A., "Dose-dependent satiating effect of whey relative to casein or soy", Physiol Behav. 96(4-5):675-82. (Mar. 23, 2009).
Volpi, E. et al., "Essential amino acids are primarily responsible for the amino acid stimulation of muscle protein anabolism in healthy elderly adults", Am J Clin Nutr. 78:250-8. (2003).
Wolfe, R. R., "Branched-Chain Amino Acids in Exercise Skeletal Muscle Protein Metabolism and Resistance Exercise", J Nutr. 525-8. (2006).
Wolfe, R. R., "Regulation of Muscle Protein by Amino Acids", J Nutr. 132:3219S-3224S. (2002).
Xi, P. et al, "Regulation of protein metabolism by glutamine: implications for nutrition and health", Front Biosci. 16:578-97. (2011).
US Pre-Interview First Office Action, U.S. Appl. No. 13/836,855, Apr. 10, 2014, 5 pages.
United States Notice of Allowance with Applicant Initiated Interview Summary U.S. Appl. No. 13/836,855, May 23, 2014, 19 pages.
US Pre-Interview First Office Action, U.S. Appl. No. 14/374,127, Oct. 8, 2015, 5 pages.
GenBank Accession No. P13915 (Jan. 1, 1990).
GenBank Accession No. Q39817 (Jul. 15, 1998).
GenBank Accession No. O82709 (Dec. 1, 2000).
GenBank Accession No. P30236 (Apr. 1, 1993).
GenBank Accession No. Q29092 (Dec. 15, 1998).
GenBank Accession No. P19244 (Nov. 1, 1990).
GenBank Accession No. Q9TV61 (Feb. 6, 2007).
GenBank Accession No. Q9TV63 (Feb. 6, 2007).
GenBank Accession No. P15590 (Apr. 1, 1990).
GenBank Accession No. Q9TV62 (Feb. 6, 2007).
GenBank Accession No. Q9SP22 (Dec. 1, 2000).
GenBank Accession No. Q9SLY8 (Dec. 1, 2000).
GenBank Accession No. P86412 (Aug. 10, 2010).
GenBank Accession No. Q6YNX6 (Oct. 25, 2005).
GenBank Accession No. Q6YNX6 (Dec. 15, 1998).
GenBank Accession No. Q08275 (Feb. 1, 1995).
GenBank Accession No. P02547 (Jul. 21, 1986).
GenBank Accession No. Q6Z6L5 (Nov. 3, 2009).
GenBank Accession No. Q0JNS6 (Jul. 10, 2007).
GenBank Accession No. Q0DJV6 (Jun. 10, 2008).
GenBank Accession No. Q0IUU4 (Jun. 10, 2008).
GenBank Accession No. P62163 (Jun. 21, 2004).
GenBank Accession No. P04353 (Mar. 20, 1987).
GenBank Accession No. A2WN93 (Jul. 10, 2007).
GenBank Accession No. A2WNH1 (Jul. 10, 2007).
GenBank Accession No. P93087 (Jul. 15, 1998).
GenBank Accession No. Q7DMN9 (Nov. 23, 2004).
GenBank Accession No. P84339 (Feb. 1, 2005).
GenBank Accession No. P24632 (Mar. 1, 1992).
GenBank Accession No. Q5ZCK5 (Jun. 10, 2008).
GenBank Accession No. Q6ES52 (Jun. 15, 2010).
GenBank Accession No. P29269 (Dec. 1, 1992).
GenBank Accession No. P41040 (Feb. 1, 1995).
GenBank Accession No. P24631 (Mar. 1, 1992).
GenBank Accession No. Q6F332 (Jul. 25, 2006).
GenBank Accession No. Q0JNL7 (Jul. 10, 2007).
GenBank Accession No. Q0IQB6 (Jun. 10, 2008).
GenBank Accession No. A2Y609 (Jun. 10, 2008).
GenBank Accession No. Q40642 (Jun. 10, 2008).
GenBank Accession No. P04464 (Aug. 13, 1987).
GenBank Accession No. P48976 (Feb. 1, 1996).
GenBank Accession No. P27161 (Aug. 1, 1992).
GenBank Accession No. Q8S1Y9 (Jun. 10, 2008).
GenBank Accession No. P13868 (Jan. 1, 1990).
GenBank Accession No. P10246 (Jul. 1, 1989).
GenBank Accession No. P46254 (Nov. 1, 1995).
GenBank Accession No. Q84MN0 (Jun. 10, 2008).
GenBank Accession No. Q2R1Z5 (Jun. 10, 2008).
GenBank Accession No. P02540 (Jul. 21, 1986).
GenBank Accession No. P21753 (May 1, 1991).
GenBank Accession No. Q75ZZ6 (May 24, 2005).
GenBank Accession No. Q6DUB7 (Jan. 24, 2006).
GenBank Accession No. Q95274 (May 10, 2005).
GenBank Accession No. P58272 (Sep. 26, 2001).
GenBank Accession No. Q8S1Z1 (Apr. 4, 2003).
GenBank Accession No. B5X4E0 (Mar. 3, 2009).
GenBank Accession No. Q08655 (Oct. 1, 1994).
GenBank Accession No. Q10B98 (Sep. 2, 2008).
GenBank Accession No. Q6H7U2 (Sep. 2, 2008).
GenBank Accession No. P46618 (Nov. 1, 1995).
GenBank Accession No. P0C380 (May 29, 2007).
GenBank Accession No. P0C379 (May 29, 2007).
GenBank Accession No. P47815 (Feb. 1, 1996).
GenBank Accession No. Q29361 (Nov. 1, 1997).
GenBank Accession No. B5X186 (Mar. 3, 2009).
GenBank Accession No. P17703 (Aug. 1, 1990).
GenBank Accession No. B5DGI7 (Jul. 7, 2009).
GenBank Accession No. P37219 (Oct. 1, 1994).
GenBank Accession No. P0C470 (Jun. 12, 2007).
GenBank Accession No. P0C469 (Jun. 12, 2007).
GenBank Accession No. P69661 (Mar. 29, 2005).
GenBank Accession No. P42755 (Nov. 1, 1995).
GenBank Accession No. P12675 (Oct. 1, 1989).
GenBank Accession No. Q6ZK48 (May 29, 2007).
GenBank Accession No. A2YQU8 (May 29, 2007).
GenBank Accession No. Q0JHZ2 (Sep. 2, 2008).
GenBank Accession No. Q9M4U5 (Aug. 30, 2005).
GenBank Accession No. Q8LH03 (Mar. 2, 2010).
GenBank Accession No. P61268 (May 10, 2004).
GenBank Accession No. B5XCZ6 (Apr. 14, 2009).
GenBank Accession No. P56276 (Jul. 15, 1998).
GenBank Accession No. P14287 (Jan. 1, 1990).
GenBank Accession No. Q9MYT8 (Sep. 26, 2001).
GenBank Accession No. Q08000 (Nov. 1, 1995).
GenBank Accession No. Q29307 (Nov. 1, 1997).
GenBank Accession No. B5XGH3 (Mar. 24, 2009).
GenBank Accession No. Q9AS36 (May 15, 2007).
GenBank Accession No. O97965 (Sep. 27, 2004).
GenBank Accession No. Q2PMN9 (Oct. 31, 2006).
GenBank Accession No. Q6Q311 (Aug. 16, 2004).
GenBank Accession No. O04438 (Jan. 1, 1995).
GenBank Accession No. P22701 (Aug. 1, 1991).
GenBank Accession No. P83884 (May 10, 2004).
GenBank Accession No. P13618 (Jan. 1, 1990).
GenBank Accession No. Q65WT0 (Mar. 7, 2006).
GenBank Accession No. Q6K5K2 (Jun. 16, 2009).
GenBank Accession No. P12026 (Oct. 1, 1989).
GenBank Accession No. Q5KQI4 (Jun. 16, 2009).
GenBank Accession No. P04568 (Aug. 13, 1987).
GenBank Accession No. Q9XGX7 (Jan. 11, 2001).
GenBank Accession No. P46291 (Nov. 1, 1995).
GenBank Accession No. Q2MI43 (Oct. 31, 2006).
GenBank Accession No. Q69V36 (Jun. 16, 2009).
GenBank Accession No. P46517 (Nov. 1, 1995).
GenBank Accession No. Q9M314 (Aug. 29, 2001).
GenBank Accession No. P67985 (Oct. 11, 2004).

(56) References Cited

OTHER PUBLICATIONS

GenBank Accession No. P48504 (Feb. 1, 1996).
GenBank Accession No. Q94DE2 (Mar. 7, 2006).
GenBank Accession No. P12151 (Oct. 1, 1989).
GenBank Accession No. P0C474 (Jun. 12, 2007).
GenBank Accession No. A2XAM1 (May 20, 2008).
GenBank Accession No. P46520 (Nov. 1, 1995).
GenBank Accession No. P41101 (Feb. 1, 1995).
GenBank Accession No. Q64L94 (Nov. 9, 2004).
GenBank Accession No. Q10RE5 (Jun. 12, 2007).
GenBank Accession No. A2XCT8 (Jun. 12, 2007).
GenBank Accession No. Q7XNS7 (Feb. 7, 2006).
GenBank Accession No. P49120 (Feb. 1, 1996).
GenBank Accession No. Q41396 (Jul. 15, 1998).
GenBank Accession No. Q2PMR3 (Feb. 6, 2007).
GenBank Accession No. Q8L805 (Apr. 13, 2004).
GenBank Accession No. P28520 (Dec. 1, 1992).
GenBank Accession No. Q5JLY8 (Jul. 25, 2006).
GenBank Accession No. O18734 (Nov. 9, 2004).
GenBank Accession No. P49680 (Feb. 1, 1996).
GenBank Accession No. Q8LJS2 (Aug. 30, 2005).
GenBank Accession No. A7WLH8 (Dec. 4, 2007).
GenBank Accession No. Q2MJV9 (Nov. 28, 2006).
GenBank Accession No. A2XAM0 (Apr. 29, 2008).
GenBank Accession No. A1L4T4 (Jun. 12, 2007).
GenBank Accession No. A2Z7C4 (Jun. 12, 2007).
GenBank Accession No. P55844 (Nov. 1, 1997).
GenBank Accession No. A5YVD9 (Jun. 16, 2009).
GenBank Accession No. P0CE66 (Mar. 23, 2010).
GenBank Accession No. B7F6L8 (Mar. 23, 2010).
GenBank Accession No. Q2VEC4 (Jan. 24, 2006).
GenBank Accession No. Q943L2 (Jul. 10, 2007).
GenBank Accession No. A2WWU2 (Jul. 10, 2007).
GenBank Accession No. O65821 (Jun. 27, 2006).
GenBank Accession No. Q2QWE9 (May 20, 2008).
GenBank Accession No. Q9ZQW8 (Sep. 2, 2008).
GenBank Accession No. Q43694 (Nov. 2, 2001).
GenBank Accession No. A2ZIW7 (May 20, 2008).
GenBank Accession No. P60099 (Nov. 28, 2003).
GenBank Accession No. P60098 (Nov. 28, 2003).
GenBank Accession No. B5XG43 (Apr. 14, 2009).
GenBank Accession No. Q6ZBP3 (Jul. 10, 2007).
GenBank Accession No. A2YWI3 (Jul. 10, 2007).
GenBank Accession No. O49118 (May 30, 2000).
GenBank Accession No. P27723 (Aug. 1, 1992).
GenBank Accession No. P25461 (May 1, 1992).
GenBank Accession No. O04433 (Dec. 15, 1998).
GenBank Accession No. Q7XEJ5 (Feb. 7, 2006).
GenBank Accession No. P62272 (Jul. 5, 2004).
GenBank Accession No. A5JST6 (Feb. 26, 2008).
GenBank Accession No. P08698 (Jan. 1, 1988).
GenBank Accession No. A5A777 (Apr. 29, 2008).
GenBank Accession No. P6290 (Aug. 31, 2004).
GenBank Accession No. B5XG19 (Jun. 16, 2009).
GenBank Accession No. A1Y2B7 (May 20, 2008).
GenBank Accession No. Q2QLT8 (Feb. 20, 2007).
GenBank Accession No. P46605 (Nov. 1, 1995).
GenBank Accession No. Q8LNU5 (Jul. 25, 2006).
GenBank Accession No. O24473 (Jul. 15, 1998).
GenBank Accession No. P68211 (Oct. 25, 2004).
GenBank Accession No. Q05462 (Feb. 1, 1994).
GenBank Accession No. B5XBI1 (May 31, 2011).
GenBank Accession No. Q43216 (Jun. 13, 2006).
GenBank Accession No. O65818 (Jun. 27, 2006).
GenBank Accession No. B5SNZ6 (Mar. 24, 2009).
GenBank Accession No. P62262 (Jul. 5, 2004).
GenBank Accession No. Q8LJU5 (Jun. 21, 2004).
GenBank Accession No. Q5FZP5 (Oct. 14, 2008).
GenBank Accession No. Q0JGY1 (Sep. 11, 2007).
GenBank Accession No. Q29561 (Nov. 1, 1997).
GenBank Accession No. Q8H2P8 (Feb. 20, 2007).
GenBank Accession No. P55871 (Nov. 1, 1997).
GenBank Accession No. P02632 (Jul. 21, 1986).
GenBank Accession No. Q40703 (Aug. 30, 2005).
GenBank Accession No. B5X7E4 (May 31, 2011).
GenBank Accession No. Q941B1 (Aug. 21, 2007).
GenBank Accession No. Q6B7M7 (Oct. 11, 2004).
GenBank Accession No. P10668 (Jul. 1, 1989).
GenBank Accession No. P30755 (Jul. 1, 1993).
GenBank Accession No. A2WXX3 (Sep. 11, 2007).
GenBank Accession No. A1XQU5 (Jul. 24, 2007).
GenBank Accession No. Q08069 (Feb. 1, 1996).
GenBank Accession No. Q712U6 (May 16, 2006).
GenBank Accession No. P28807 (Dec. 1, 1992).
GenBank Accession No. P80220 (Oct. 1, 1993).
GenBank Accession No. P0C267 (Dec. 12, 2006).
GenBank Accession No. Q2M177 (Feb. 6, 2007).
GenBank Accession No. Q2VEF5 (Feb. 6, 2007).
GenBank Accession No. Q2PMR2 (Feb. 6, 2007).
GenBank Accession No. P28803 (Dec. 1, 1992).
GenBank Accession No. Q5G6V9 (Sep. 13, 2005).
GenBank Accession No. A5YVF1 (May 20, 2008).
GenBank Accession No. P27807 (Aug. 1, 1992).
GenBank Accession No. Q41418 (Nov. 1, 1997).
GenBank Accession No. Q95H63 (Aug. 30, 2002).
GenBank Accession No. P02754 (Jul. 21, 1986).
GenBank Accession No. P02662 (Jul. 21, 1986).
GenBank Accession No. P29290 (Dec. 1, 1992).
GenBank Accession No. Q5ZMN0 (Mar. 6, 2007).
GenBank Accession No. P35622 (Jun. 1, 1994).
GenBank Accession No. P02586 (Jul. 21, 1986).
GenBank Accession No. P63317 (Aug. 13, 1987).
GenBank Accession No. P63315 (Aug. 13, 1987).
GenBank Accession No. P60660 (Mar. 29, 2004).
GenBank Accession No. P02607 (Jul. 21, 1986).
GenBank Accession No. P02605 (Jul. 21, 1986).
GenBank Accession No. Q41784 (Dec. 1, 2000).
GenBank Accession No. P02587 (Jul. 21, 1986).
GenBank Accession No. Q030J7 (Feb. 5, 2008).
GenBank Accession No. Q8DHS3 (Nov. 21, 2003).
GenBank Accession No. Q5FJI8 (Feb. 26, 2008).
GenBank Accession No. Q9WZD0 (Aug. 2, 2002).
GenBank Accession No. Q74IP1 (Feb. 26, 2008).
GenBank Accession No. P06787 (Jan. 1, 1988).
GenBank Accession No. P52193 (Oct. 1, 1996).
GenBank Accession No. P67975 (Jul. 21, 1986).
Australian First Examination Report, Australian Application No. 2013240183, May 16, 2016, 2 pages.
Pennings, B. et al., "Whey Protein Stimulated Postprandial Muscle Protein Accretion More Effectively Than Do Casein and Casein Hydrolysate in Older Men," Am. J. Clin. Nutr., Mar. 2, 2011, American Society for Nutrition, pp. 1-9.
United States Pre-Interview First Office Action, U.S. Appl. No. 14/387,677, May 2, 2016, 5 pages.
Beg, O.U. et al., "Characterization of a Heterogeneous Camel Milk Whey Non-Casein Protein," FEBS Letters, Jun. 1987, pp. 270-274, vol. 216, No. 2.
Bolotin, A. et al., "The Complete Genome Sequence of the Lactic Acid Bacterium Lactococcus lactis ssp. Lactis IL1403," Genome Research, 2001, pp. 731-753.
Broadbent, J.R. et al., "Contribution of Lactococcus lactis Cell Envelope Proteinase Specificity to Peptide Accumulation and Bitterness in Reduced-Fat Cheddar Cheese," Appled and Environmental Microbiology, Apr. 2002, pp. 1778-1785, vol. 68, No. 4.
Chinese First Office Action, Chinese Application No. 2013800273657, Feb. 24, 2016, 35 pages.
Ning, L. et al., "Biological Function of Branched Amino Acid in Sports Nutrition Supply and Its Application in Athletic Practice," Journal of Gansu Lianhe Univeristy (Natural Sicence Division), Jul. 10, 2009, pp. 117-119, vol. 23 (with English abstract).
Russian Office Action, Russian Application No. 2014143029/10(069500), Mar. 28, 2016, 7 pages.

(56) References Cited

OTHER PUBLICATIONS

Wang, X., "Effects of Essential Amino Acids in Food on Human Body Health," Food and Nutrition in China, Jul. 28, 2005, pp. 48-49, Iss. 7 (with concise explanation of relevance).
United States Pre-Interview First Office Action, U.S. Appl. No. 14/387,679, Feb. 24, 2016, 5 pages.
United States Office Action, U.S. Appl. No. 14/387,675, Apr. 7, 2016, 13 pages.
Database UniProtKB [online] Feb. 22, 2012, "RecName: Full=Myosin-8: AltName: Full=Myosin heavy chain 8; AltName: Full=Myosin heavy chain, skeletal muscle, perinatal: Short=MyHC-perinatal", [retrieved on Dec. 22, 2016], Accession No. P13542.
Database UniProtKB [online] Mar. 21, 2012, "Serine/threonine-protein kinase MEC1", [retrieved on Dec. 22, 2016], Accession No. P38111.
Database UniProtKB [online] Mar. 21, 2012, "RecName: Full=Reticulon-like protein B13; Short=AtRTNLB13", [retrieved on Dec. 22, 2016], Accession No. O64837.
Database UniProtKB [online] Mar. 21, 2012, "RecName: Full=Calmodulin; Short=CaM",[retrieved on Dec. 22, 2016], Accession No. P06787.
Database UniProtKB [online] Feb. 22, 2012, "RecName: Full=Acyl carrier protein; Short=ACP", [retrieved on Dec. 22, 2016], Accession No. Q9CHF9.
Israel Office Action, Israel Application No. 234621, Dec. 18, 2016, 4 pages (with concise explanation of relevance).
Japanese Office Action, Japanese Application No. 2015-503329, Jan. 10, 2017, 9 pages (with English summary).
Japanese Office Action, Japanese Application No. 2015-503330, Jan. 10, 2017, 7 pages (with English summary).
Japanese Office Action, Japanese Application No. 2015/503331, Jan. 10, 2017, 7 pages (with English summary).
Japanese Office Action, Japanese Application No. 2015-503332, Jan. 10, 2017, 8 pages (with English summary).
Australian First Examination Report, Australian Application No. 2013240271, Oct. 19, 2016, 4 pages.
Australian First Examination Report, Australian Application No. 2013240184, Oct. 19, 2016, 4 pages.
Chinese Second Office Action, Chinese Application No. 201380027365.7, Nov. 28, 2016, 5 pages (with concise explanation of relevance).
European Examination Report, European Application No. 13770153.8, Oct. 27, 2016, 5 pages.
European Examination Report, European Application No. 13770012.6, Nov. 8, 2016, 4 pages.
European Extended Search Report, European Application No. 13767426.3, Nov. 9, 2016, 18 pages.
European Examination Report, European Application No. 13768128.4, Nov. 29, 2016, 7 pages.
Itoh, K. et al., "Neuronal Cell Expression of Inserted Isoforms of Vertebrate Nonmuscle Myosin Heavy Chain II-B," The Journal of Biological Chemistry, Jun. 1995, pp. 14533-14540, vol. 279, No. 24.
Russian Office Action, Russian Application No. 2014143031/10(069502), Sep. 7, 2016, 9 pages.
Russian Office Action, Russian Application No. 2014143029/10(069500), Oct. 20, 2016, 10 pages.
United States Miscellaneous Communication to Applicant, U.S. Appl. No. 14/387,679, Sep. 20, 2016, 2 pages.
United States Miscellaneous Communication to Applicant, U.S. Appl. No. 14/387,675, Oct. 20, 2016, 6 pages.
United States Office Action, U.S. Appl. No. 14/387,677, Oct. 20, 2016, 17 pages.
Chinese First Office Action, Chinese Application No. 201380027476.8, Jun. 28, 2016, 19 pages.
Churchward-Venne, T.A. et al. "Ingestion of Casein in a Milk Matrix Modulates Dietary Protein Digestion and Absorption Kinetics but Does Not Modulate Postprandial Muscle Protein Synthesis in Older Men" Journal of Nutrition, 2015; 145:1438-45.
Davis, T.N. et al., "Isolation of the Yeast Calmodulin Gene: Calmodulin is an Essential Protein," Cell, Cell Press, Nov. 7, 1986, pp. 423-431, vol. 47, No. 3.
European Partial Supplementary Search Report, European Application No. 13767426.3, Jul. 19, 2016, 11 pages.
Halachmi, D. et al., "Calcium Homeostasis in Yeast Cells Exposed to High Concentrations of Calcium Roles of Vacuolar H+-ATPase and Cellular ATP" FEBS 1993; 316(1): 73-78.
Israel Office Action, Israel Application No. 234617, Sep. 5, 2016, 3 pages (with concise explanation of relevance).
"Lactose, Fat & Other Proteins Impair Digestion of Micellar Casein W/Out Modifying Protein Synthesis or Breakdown, SuppVersity—Nutrition and Exercise Science for Everyone," Jun. 4, 2015, 3 pages, [Online] [Retrieved on Jun. 29, 2016] Retrieved from the Internet<URL:http://suppversity.blogspot.com/2015/06/lactosefatotherproteinsimpair.html>.
United States Office Action, U.S. Appl. No. 14/374,127, May 11, 2016, 13 pages.
United States Office Action, U.S. Appl. No. 14/387,679, Jul. 14, 2016, 10 pages.
United States Office Action, U.S. Appl. No. 14/337,563, Sep. 30, 2016, 11 pages.
Valli, M. et al. "Intracellular pH Distribution in *Saccharomyces cerevisiae* Cell Populations, Analyzed by Flow Cytometry" Applied and Environmental Microbiology, 2005; 71(3): 1515-1521.

\* cited by examiner

NUTRITIVE FRAGMENTS, PROTEINS AND METHODS

REFERENCE TO RELATED APPLICATION

This application claims priority to PCT Application No. PCT/US2013/032180, which was filed Mar. 15, 2013, which claims priority to U.S. Provisional Patent Application No. 61/615,819, filed Mar. 26, 2012, and Provisional Patent Application No. 61/728,685, filed Nov. 20, 2012, each of which are hereby incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on Mar. 12, 2013, is named 1005.014-PCT_SL.txt and is 10,802,713 bytes in size.

INTRODUCTION

Dietary protein is an essential nutrient for human health and growth. The World Health Organization recommends that dietary protein should contribute approximately 10 to 15% of energy intake when in energy balance and weight stable. Average daily protein intakes in various countries indicate that these recommendations are consistent with the amount of protein being consumed worldwide. Meals with an average of 20 to 30% of energy from protein are representative of high-protein diets when consumed in energy balance.

The body cannot synthesize certain amino acids that are necessary for health and growth, and instead must obtain them from food. These amino acids, called "essential amino acids", are Histidine (H), Isoleucine (I), Leucine (L), Lysine (K), Methionine (M), Phenylalanine (F), Threonine (T), Tryptophan (W), and Valine (V). Dietary proteins that provide all the essential amino acids are referred to as "high quality" proteins. Animal foods such as meat, fish, poultry, eggs, and dairy products are generally regarded as high quality protein sources that provide a good balance of essential amino acids. Casein (a protein commonly found in mammalian milk, making up 80% of the proteins in cow milk) and whey (the protein in the liquid that remains after milk has been curdled and strained) are major sources of high quality dietary protein. Foods that do not provide a good balance of essential amino acids are referred to as "low quality" proteins. Most fruits and vegetables are poor sources of protein. Some plants foods including beans, peas, lentils, nuts and grains (such as wheat) are better sources of protein. Soy, a vegetable protein manufactured from soybeans, is considered by some to be a high quality protein.

The minimum fractions of each essential amino acid that make up a healthy adult diet provide a metric against which dietary protein sources can be measured. For example, the fractions can be used to measure how well a dietary protein source meets the nutritional protein needs of humans, by targeting nutritionally balanced amino acid percentages. The World Health Organization (WHO) has developed a method for ranking the nutritional quality of a protein that compares the amino acid profile of the specific food protein against the amino acid requirements for human health. This method assigns a nutritional value to the protein called the "Protein Digestibility Corrected Amino Acid Score" (PDCAAS). Recently the WHO has renamed and slightly revised the PDCAAS standard, giving the revised standard the name "Digestible Indispensable Amino Acid Score (DIAAS)". (See "Dietary Protein Quality Evaluation in Human Nutrition: Report of an FAO Expert Consultation," FAO Food and Nutrution Paper 92 (2013).) The new standard revises somewhat the digestibility assumptions used to calculate a DIAAS score versus a PDCAAS score. In many instances the two standards are largely interchangeable.

Studies of the acute effects of consuming high amounts of protein in humans have shown that inclusion and in some cases increasing protein content in the diet can have beneficial effects. For example, studies have shown that ingestion of protein can induce postprandial satiety (including by suppressing hunger), induce thermogenesis and reduce glycemic response in human subjects.

Studies of high protein diets for weight loss have shown that protein positively affects energy expenditure and lean body mass. Further studies have shown that overeating produces significantly less weight gain in diets containing at least 5% of energy from protein, and that a high-protein diet decreases energy intake.

Clinical studies provide evidence that protein prevents muscle loss due to aging or bed rest. In particular, studies have shown that protein supplementation increases muscle fractional synthetic rate (FSR) during prolonged bed rest, maintains leg mass and strength during prolonged bed rest, increases lean body mass, improves functional measures of gait and balance, and may serve as a viable intervention for individuals at risk of sarcopenia due to immobility or prolonged bed rest.

Studies on increasing muscle protein anabolism in athletes have shown that protein provided following exercise promotes muscle hypertrophy to a greater extent than that achieved by exercise alone. It has also been shown that protein provided following exercise supports protein synthesis without any increase in protein breakdown, resulting in a net positive protein balance and muscle mass accretion. While muscle protein synthesis appears to respond in a dose-response fashion to essential amino acid supplementation, not all proteins are equal in building muscle. For example, milk proteins appear to be superior to soy in supporting muscle mass accretion with resistance training, while both are superior to carbohydrate alone. The amino acid leucine is an important factor in stimulating muscle protein synthesis.

Whole proteins commonly found in foods do not necessarily provide an amino acid composition that meets the amino acid requirements of a mammal, such as a human, in an efficient manner. The result is that, in order to attain the minimal requirements of each essential amino acid, a larger amount of total protein must be consumed in the diet than would be required if the quality of the dietary protein were higher. By increasing the quality of the protein in the diet it is possible to reduce the total amount of protein that must be consumed compared to diets that include lower quality proteins.

In general, proteins that have higher protein quality are considered more beneficial in a mammalian diet than other proteins that do not. Such proteins are useful, for example, as components of a mammalian diet. Under certain circumstances such proteins promote maintenance of muscle mass, a healthy body mass index, and glycemic balance, among other things. Accordingly, there is a need for sources of proteins that have high protein quality.

Traditionally, desirable mixtures of amino acids, such as mixtures comprising essential amino acids, have been provided by hydrolyzing a protein with relatively high levels of essential amino acids, such as whey protein, and/or by combining free amino acids in a mixture that optionally also includes a hydrolyzed protein such as whey. Mixtures of this type may have a bitter taste and may be deemed unsuitable or undesirable for certain uses. As a result, such mixtures sometimes include flavoring agents to mask the taste of the free amino acids and/or hydrolyzed protein. In some cases compositions in which a proportion of the amino acid content is provided by polypeptides or proteins are found to have a better taste than compositions with a high proportion of total amino acids provided as free amino acids and/or certain hydrolyzed proteins. The availability of such compositions has been limited, however, because nutritional formulations have traditionally been made from protein isolated from natural food products, such as whey isolated from milk, or soy protein isolated from soy. The amino acid profiles of those proteins do not necessarily meet the amino acid requirements for a mammal. In addition, commodity proteins typically consist of mixtures of proteins and/or protein hydrolysates which can vary in their protein composition, thus leading to unpredictability regarding their nutritional value. Moreover, the limited number of sources of such high quality proteins has meant that only certain combinations of amino acids are available on a large scale for ingestion in protein form.

The agricultural methods required to supply high quality animal protein sources such as casein and whey, eggs, and meat, as well as plant proteins such as soy, also require significant energy inputs and have potentially deleterious environmental impacts. Accordingly, it would be useful in certain situations to have alternative sources and methods of supplying proteins for mammalian consumption.

In theory, synthetic polypeptide sequences comprising a desired mixture of amino acids could be designed and produced in a laboratory setting. This approach may raise various concerns, however, and is therefore not always applicable. First, skilled artisans are aware that obtaining high levels of production of such synthetic sequences may be very challenging. Second, even if such a synthetic protein were synthesized, its suitability for use in a nutritive product would be uncertain. For example, such a non-naturally occurring polypeptide could be an allergen or a toxin. Accordingly, in some embodiments this disclosure provides natural protein or polypeptide sequences, or variants thereof.

In this disclosure the inventors provide nutritive proteins that comprise or consist of naturally-occurring nutritive proteins, fragments of naturally-occurring nutritive proteins, or sequences derived from such proteins and fragments. The nutritive proteins and the fragments of which they are composed are made up of useful combinations of amino acids. The proteins may be produced by methods that do not rely solely on traditional agriculture for production. For example, the inventors have discovered and this disclosure provides naturally occurring nutritive proteins and fragments composed of combinations of amino acids that contain a useful balance of essential amino acids, as well as in some embodiments a useful balance of non-essential amino acids.

This disclosure also provides nucleic acids encoding the proteins, recombinant microorganisms that make the proteins, methods of making the proteins using recombinant microorganisms, compositions that comprise the proteins, and methods of using the proteins, among other things.

SUMMARY

In a first aspect this disclosure provides nutritive proteins comprising a first polypeptide sequence, wherein at least 50% by weight of the amino acids in the first polypeptide sequence are essential amino acids, and wherein the first polypeptide sequence has a protein digestibility corrected amino acid score (PDCAAS) of at least about 1.4. In some embodiments the first polypeptide sequence has a PDCAAS of from about 1.4 to about 1.8. In some embodiments the first polypeptide sequence comprises a weight ratio of at least 60% essential amino acids. In some embodiments the first polypeptide sequence has a PDCAAS of from about 1.4 to about 2.2. In some embodiments the first polypeptide sequence comprises a weight ratio of at least 70% essential amino acids. In some embodiments the first polypeptide sequence has a PDCAAS of from about 1.4 to about 2.5. In some embodiments the first polypeptide sequence comprises a weight ratio of at least 80% essential amino acids. In some embodiments the first polypeptide sequence has a PDCAAS of from about 1.4 to about 2.9. In some embodiments the first polypeptide sequence comprises a weight ratio of at least 90% essential amino acids. In some embodiments the first polypeptide sequence has a PDCAAS of from about 1.4 to about 3.2. In some embodiments the nutritive protein further comprises at least one of every non-essential amino acid. In some embodiments the nutritive protein further comprises at least one of every non-essential and conditionally-essential amino acid. In some embodiments the nutritive protein further comprises a nutritionally balanced ratio of non-essential amino acids. In some embodiments the first polypeptide sequence comprises a weight ratio of each non-essential amino acid to the total number of amino acids that is equivalent to the weight ratio of each non-essential amino acid to the total number of amino acids in a benchmark protein. In some embodiments the benchmark protein is selected from whey protein, egg protein and soy protein. In some embodiments the first polypeptide sequence comprises 100% essential and conditionally essential amino acids. In some embodiments wherein the first polypeptide sequence has a PDCAAS of from about 1.4 to about 3.6.

In some embodiments the first polypeptide sequence comprises at least 70% homology to at least 50 amino acids of a naturally occurring protein or fragment thereof. In some embodiments the first polypeptide sequence comprises at least 95% homology to at least 50 amino acids of a naturally occurring protein or fragment thereof. In some embodiments the first polypeptide sequence comprises at least 70% homology to a naturally occurring protein or fragment thereof. In some embodiments the first polypeptide sequence comprises at least 95% homology to a naturally occurring protein or fragment thereof. In some embodiments the first polypeptide sequence comprises a naturally occurring protein or fragment thereof. In some embodiments the first polypeptide sequence comprises an altered amino acid sequence compared to the amino acid sequence of a naturally occurring reference protein and a weight ratio of essential amino acids to total amino acids present in the nutritive protein that is higher than the weight ratio of essential amino acids to total amino acids present in the naturally occurring reference protein. In some embodiments the first polypeptide sequence comprises at least one essential amino acid residue substitution of a non-essential amino acid residue in the naturally occurring reference protein.

In some embodiments the first polypeptide sequence is not an allergen. In some embodiments the first polypeptide sequence has less than 50% global homology to a known allergen.

In some embodiments the first polypeptide sequence is not a toxin. In some embodiments the first polypeptide sequence has less than 50% global homology to a known toxin.

In some embodiments the first polypeptide sequence has a simulated gastric digestion half-life of less than 60 minutes. In some embodiments the first polypeptide sequence has a simulated gastric digestion half-life of less than 30 minutes. In some embodiments the first polypeptide sequence has a simulated gastric digestion half-life of less than 10 minutes. In some embodiments the first polypeptide sequence is completely digested in simulated gastric fluid. In some embodiments the first polypeptide sequence comprises at least one protease recognition site selected from a pepsin recognition site, a trypsin recognition site, and a chymotrypsin recognition site. In some embodiments the first polypeptide sequence comprises no cysteine residues. In some embodiments the first polypeptide sequence comprises no disulfide bonds. In some embodiments the first polypeptide sequence does not comprise N-linked glycosylation. In some embodiments the first polypeptide sequence does not comprise O-linked glycosylation.

In some embodiments the first polypeptide sequence is resistant to aggregation. In some embodiments the first polypeptide sequence is anionic at pH 7. In some embodiments the first polypeptide sequence has an aqueous solubility at pH 7 of at least 12.5 g/L. In some embodiments the first polypeptide sequence has a calculated solvation score of −20 or less. In some embodiments the first polypeptide sequence has a calculated aggregation score of 0.75 or less. In some embodiments the first polypeptide sequence has a calculated aggregation score of 0.5 or less.

In some embodiments the first polypeptide sequence comprises at least 20 amino acids. In some embodiments the first polypeptide sequence comprises at least 50 amino acids. In some embodiments the first polypeptide sequence is selected from: A. an amino acid sequence comprising the amino acid sequence of a protein listed in at least one of Tables 9-11; B. an amino acid sequence comprising a modified derivative of the amino acid sequence of a protein listed in at least one of Tables 9-11; C. an amino acid sequence comprising a mutein of the amino acid sequence of a protein listed in at least one of Tables 9-11; D. an amino acid sequence comprising a fragment of at least 20 amino acids of the amino acid sequence of a protein listed in at least one of Tables 9-11; E. an amino acid sequence comprising a modified derivative of a fragment of at least 20 amino acids of the amino acid sequence of a protein listed in at least one of Tables 9-11; F. an amino acid sequence comprising a mutein of a fragment of at least 20 amino acids of the amino acid sequence of a protein listed in at least one of Tables 9-11; G. an amino acid sequence comprising the amino acid sequence of a fragment listed in at least one of Tables 6-8; H. an amino acid sequence comprising a modified derivative of the amino acid sequence of a fragment listed in at least one of Tables 6-8; and I. an amino acid sequence comprising a mutein of the amino acid sequence of a fragment listed in at least one of Tables 6-8.

In some embodiments the first polypeptide sequence consists of at least 20 amino acids. In some embodiments the first polypeptide sequence consists of at least 50 amino acids. In some embodiments the first polypeptide sequence is selected from: A. an amino acid sequence consisting of the amino acid sequence of a protein listed in at least one of Tables 9-11; B. an amino acid sequence consisting of a modified derivative of the amino acid sequence of a protein listed in at least one of Tables 9-11; C. an amino acid sequence consisting of a mutein of the amino acid sequence of a protein listed in at least one of Tables 9-11; D. an amino acid sequence consisting of a fragment of at least 20 amino acids of the amino acid sequence of a protein listed in at least one of Tables 9-11; E. an amino acid sequence consisting of a modified derivative of a fragment of at least 20 amino acids of the amino acid sequence of a protein listed in at least one of Tables 9-11; F. an amino acid sequence consisting of a mutein of a fragment of at least 20 amino acids of the amino acid sequence of a protein listed in at least one of Tables 9-11; G. an amino acid sequence consisting of the amino acid sequence of a fragment listed in at least one of Tables 6-8; H. an amino acid sequence consisting of a modified derivative of the amino acid sequence of a fragment listed in at least one of Tables 6-8; and I. an amino acid sequence consisting of a mutein of the amino acid sequence of a fragment listed in at least one of Tables 6-8.

In some embodiments the first polypeptide sequence is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to an amino acid sequence selected from: A. the amino acid sequence of a protein listed in at least one of Tables 9-11; B. a fragment of at least 20 amino acids of the amino acid sequence of a protein listed in at least one of Tables 9-11; and C. the amino acid sequence of a fragment listed in at least one of Tables 6-8.

In some embodiments the first polypeptide sequence is selected from: A. an amino acid sequence consisting of the amino acid sequence of a sequence selected from SEQ ID NOS: 1-4406 and 4409-4426; B. an amino acid sequence consisting of a modified derivative of the amino acid sequence of a sequence selected from SEQ ID NOS: 1-4406 and 4409-4426; C. an amino acid sequence consisting of a mutein of the amino acid sequence of a sequence selected from SEQ ID NOS: 1-4406 and 4409-4426; D. an amino acid sequence consisting of a fragment of at least 20 amino acids of the amino acid sequence of a sequence selected from SEQ ID NOS: 1-4406 and 4409-4426; E. an amino acid sequence consisting of a modified derivative of a fragment of at least 20 amino acids of the amino acid sequence of a sequence selected from SEQ ID NOS: 1-4406 and 4409-4426; and F. an amino acid sequence consisting of a mutein of a fragment of at least 20 amino acids of the amino acid sequence of a sequence selected from SEQ ID NOS: 1-4406 and 4409-4426.

In some embodiments the first polypeptide sequence is selected from: A. an amino acid sequence comprising the amino acid sequence of a sequence selected from SEQ ID NOS: 1-4406 and 4409-4426; B. an amino acid sequence comprising a modified derivative of the amino acid sequence of a sequence selected from SEQ ID NOS: 1-4406 and 4409-4426; C. an amino acid sequence comprising a mutein of the amino acid sequence of a sequence selected from SEQ ID NOS: 1-4406 and 4409-4426; D. an amino acid sequence comprising a fragment of at least 20 amino acids of the amino acid sequence of a sequence selected from SEQ ID NOS: 1-4406 and 4409-4426; E. an amino acid sequence comprising a modified derivative of a fragment of at least 20 amino acids of the amino acid sequence of a sequence selected from SEQ ID NOS: 1-4406 and 4409-4426; and F. an amino acid sequence comprising a mutein of a fragment of at least 20 amino acids of the amino acid sequence of a sequence selected from SEQ ID NOS: 1-4406 and 4409-4426.

In some embodiments the first polypeptide sequence is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to an amino acid sequence selected from the amino acid sequence of a sequence selected from SEQ ID NOS: 1-4406 and 4409-4426.

In some embodiments the nutritive protein consists of the first polypeptide sequence.

In some embodiments the nutritive protein further comprises a polypeptide tag for affinity purification. In some embodiments the tag for affinity purification is a polyhistidine-tag.

In another aspect this disclosure provides nutritive proteins comprising at least 50% by weight essential amino acids, wherein the nutritive protein has a protein digestibility corrected amino acid score (PDCAAS) of at least about 1.4. In some embodiments the nutritive protein has a PDCAAS of from about 1.4 to about 1.8. In some embodiments the nutritive protein comprises a weight ratio of at least 60% essential amino acids. In some embodiments the nutritive protein has a PDCAAS of from about 1.4 to about 2.2. In some embodiments the nutritive protein comprises a weight ratio of at least 70% essential amino acids. In some embodiments the nutritive protein has a PDCAAS of from about 1.4 to about 2.5. In some embodiments the nutritive protein comprises a weight ratio of at least 80% essential amino acids. In some embodiments the nutritive protein has a PDCAAS of from about 1.4 to about 2.9. In some embodiments the nutritive protein comprises a weight ratio of at least 90% essential amino acids. In some embodiments the nutritive protein has a PDCAAS of from about 1.4 to about 3.2. In some embodiments the nutritive protein further comprises at least one of every non-essential amino acid. In some embodiments the nutritive protein further comprises at least one of every non-essential and conditionally-essential amino acid. In some embodiments the nutritive protein further comprises a nutritionally balanced ratio of non-essential amino acids. In some embodiments the nutritive protein comprises a weight ratio of each non-essential amino acid to the total number of amino acids that is equivalent to the weight ratio of each non-essential amino acid to the total number of amino acids in a benchmark protein. In some embodiments the benchmark protein is selected from whey protein, egg protein and soy protein. In some embodiments the nutritive protein comprises 100% essential and conditionally essential amino acids. In some embodiments the nutritive protein has a PDCAAS of from about 1.4 to about 3.6.

In some embodiments the nutritive protein comprises at least 70% homology to at least 50 amino acids of a naturally occurring protein or fragment thereof. In some embodiments the nutritive protein comprises at least 95% homology to at least 50 amino acids of a naturally occurring protein or fragment thereof. In some embodiments the nutritive protein comprises at least 70% homology to a naturally occurring protein or fragment thereof. In some embodiments the nutritive protein comprises at least 95% homology to a naturally occurring protein or fragment thereof. In some embodiments the nutritive protein comprises a naturally occurring protein or fragment thereof. In some embodiments the nutritive protein comprises an altered amino acid sequence compared to the amino acid sequence of a naturally-occurring reference protein and a weight ratio of essential amino acids to total amino acids present in the nutritive protein that is higher than the weight ratio of essential amino acids to total amino acids present in the naturally-occurring reference protein. In some embodiments the nutritive protein comprises at least one essential amino acid residue substitution of a non-essential amino acid residue in the naturally occurring reference protein.

In some embodiments the nutritive protein is not an allergen. In some embodiments the nutritive protein has less than 50% global homology to a known allergen.

In some embodiments the nutritive protein is not a toxin. In some embodiments the nutritive protein has less than 50% global homology to a known toxin.

In some embodiments the nutritive protein has a simulated gastric digestion half-life of less than 60 minutes. In some embodiments the nutritive protein has a simulated gastric digestion half-life of less than 30 minutes. In some embodiments the nutritive protein has a simulated gastric digestion half-life of less than 10 minutes. In some embodiments the nutritive protein is completely digested in simulated gastric fluid. In some embodiments the nutritive protein comprises at least one protease recognition site selected from a pepsin recognition site, a trypsin recognition site, and a chymotrypsin recognition site. In some embodiments the nutritive protein comprises no cysteine residues. In some embodiments the nutritive protein comprises no disulfide bonds. In some embodiments the nutritive protein does not comprise N-linked glycosylation. In some embodiments the nutritive protein does not comprise O-linked glycosylation.

In some embodiments the nutritive protein is resistant to aggregation. In some embodiments the nutritive protein is anionic at pH 7. In some embodiments the nutritive protein has an aqueous solubility at pH 7 of at least 12.5 g/L. In some embodiments the nutritive protein has a calculated solvation score of −20 or less. In some embodiments the nutritive protein has a calculated aggregation score of 0.75 or less. In some embodiments the nutritive protein has a calculated aggregation score of 0.5 or less.

In some embodiments the nutritive protein comprises at least 20 amino acids. In some embodiments the nutritive protein comprises at least 50 amino acids.

In some embodiments the nutritive protein comprises at least 20 amino acids. In some embodiments the nutritive protein comprises at least 50 amino acids. In some embodiments the nutritive protein is selected from: A. an amino acid sequence comprising the amino acid sequence of a protein listed in at least one of Tables 9-11; B. an amino acid sequence comprising a modified derivative of the amino acid sequence of a protein listed in at least one of Tables 9-11; C. an amino acid sequence comprising a mutein of the amino acid sequence of a protein listed in at least one of Tables 9-11; D. an amino acid sequence comprising a fragment of at least 20 amino acids of the amino acid sequence of a protein listed in at least one of Tables 9-11; E. an amino acid sequence comprising a modified derivative of a fragment of at least 20 amino acids of the amino acid sequence of a protein listed in at least one of Tables 9-11; F. an amino acid sequence comprising a mutein of a fragment of at least 20 amino acids of the amino acid sequence of a protein listed in at least one of Tables 9-11; G. an amino acid sequence comprising the amino acid sequence of a fragment listed in at least one of Tables 6-8; H. an amino acid sequence comprising a modified derivative of the amino acid sequence of a fragment listed in at least one of Tables 6-8; and I. an amino acid sequence comprising a mutein of the amino acid sequence of a fragment listed in at least one of Tables 6-8.

In some embodiments the nutritive protein consists of at least 20 amino acids. In some embodiments the nutritive protein consists of at least 50 amino acids. In some embodiments the nutritive protein is selected from: A. an amino acid sequence consisting of the amino acid sequence of a protein listed in at least one of Tables 9-11; B. an amino acid sequence consisting of a modified derivative of the amino acid sequence of a protein listed in at least one of Tables 9-11; C. an amino acid sequence consisting of a mutein of the amino acid sequence of a protein listed in at least one of Tables 9-11; D. an amino acid sequence consisting of a fragment of at least 20 amino acids of the amino acid sequence of a protein listed in at least one of Tables 9-11; E. an amino acid sequence consisting of a modified derivative of a fragment of at least 20 amino acids of the amino acid sequence of a protein listed in at least one of Tables 9-11; F. an amino acid sequence consisting of a mutein of a fragment of at least 20 amino acids of the amino acid sequence of a protein listed in at least one of Tables 9-11; G. an amino acid sequence consisting of the amino acid sequence of a fragment listed in at least one of Tables 6-8; H. an amino acid sequence consisting of a modified derivative of the amino acid sequence of a fragment listed in at least one of Tables 6-8; and I. an amino acid sequence consisting of a mutein of the amino acid sequence of a fragment listed in at least one of Tables 6-8.

In some embodiments the nutritive protein is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to an amino acid sequence selected from: A. the amino acid sequence of a protein listed in at least one of Tables 9-11; B. a fragment of at least 20 amino acids of the amino acid sequence of a protein listed in at least one of Tables 9-11; and C. the amino acid sequence of a fragment listed in at least one of Tables 6-8.

In some embodiments the nutritive protein is selected from: A. an amino acid sequence consisting of the amino acid sequence of a sequence selected from SEQ ID NOS: 1-4406 and 4409-4426; B. an amino acid sequence consisting of a modified derivative of the amino acid sequence of a sequence selected from SEQ ID NOS: 1-4406 and 4409-4426; C. an amino acid sequence consisting of a mutein of the amino acid sequence of a sequence selected from SEQ ID NOS: 1-4406 and 4409-4426; D. an amino acid sequence consisting of a fragment of at least 20 amino acids of the amino acid sequence of a sequence selected from SEQ ID NOS: 1-4406 and 4409-4426; E. an amino acid sequence consisting of a modified derivative of a fragment of at least 20 amino acids of the amino acid sequence of a sequence selected from SEQ ID NOS: 1-4406 and 4409-4426; and F. an amino acid sequence consisting of a mutein of a fragment of at least 20 amino acids of the amino acid sequence of a sequence selected from SEQ ID NOS: 1-4406 and 4409-4426.

In some embodiments the nutritive protein is selected from: A. an amino acid sequence comprising the amino acid sequence of a sequence selected from SEQ ID NOS: 1-4406 and 4409-4426; B. an amino acid sequence comprising a modified derivative of the amino acid sequence of a sequence selected from SEQ ID NOS: 1-4406 and 4409-4426; C. an amino acid sequence comprising a mutein of the amino acid sequence of a sequence selected from SEQ ID NOS: 1-4406 and 4409-4426; D. an amino acid sequence comprising a fragment of at least 20 amino acids of the amino acid sequence of a sequence selected from SEQ ID NOS: 1-4406 and 4409-4426; E. an amino acid sequence comprising a modified derivative of a fragment of at least 20 amino acids of the amino acid sequence of a sequence selected from SEQ ID NOS: 1-4406 and 4409-4426; and F. an amino acid sequence comprising a mutein of a fragment of at least 20 amino acids of the amino acid sequence of a sequence selected from SEQ ID NOS: 1-4406 and 4409-4426.

In some embodiments the nutritive protein is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to an amino acid sequence selected from the amino acid sequence of a sequence selected from SEQ ID NOS: 1-4406 and 4409-4426.

In some embodiments the nutritive protein further comprises a polypeptide tag for affinity purification. In some embodiments the tag for affinity purification is a polyhistidine-tag.

In some embodiments the nutritive protein of this disclosure is recombinant. In some embodiments the nutritive protein of this disclosure is isolated. In some embodiments the nutritive protein of this disclosure is purified.

In another aspect this disclosure provides isolated nucleic acids comprising a nucleic acid sequence that encodes a nutritive protein of this disclosure. In some embodiments the isolated nucleic acid is selected from genomic DNA, cDNA, sense RNA and antisense RNA. In some embodiments the isolated nucleic acid is genomic DNA. In some embodiments the isolated nucleic acid is cDNA. In some embodiments the isolated nucleic acid further comprises an expression control sequence operatively linked to the nucleic acid sequence that encodes the nutritive protein.

In another aspect this disclosure provides a vector comprising a nucleic acid sequence that encodes a nutritive protein of this disclosure. In some embodiments the vector further comprises an expression control sequence operatively linked to the nucleic acid sequence that encodes the nutritive protein In another aspect this disclosure provides a recombinant microorganism comprising at least one of a nucleic acid of this disclosure and a vector of this disclosure. In some embodiments the recombinant microorganism is a prokaryote. In some embodiments the prokaryote is heterotrophic. In some embodiments the prokaryote is autotrophic. In some embodiments the prokaryote is a bacteria.

In another aspect this disclosure provides methods of making a nutritive protein of this disclosure, the method comprising culturing a recombinant microorganism of this disclosure under conditions sufficient for production of the nutritive protein by the recombinant microorganism. In some embodiments the methods further comprise isolating the nutritive protein from the culture.

In another aspect this disclosure provides nutritive compositions comprising a nutritive protein of this disclosure and at least one second component. In some embodiments the second component is selected from a protein, a polypeptide, a peptide, a free amino acid, a carbohydrate, a fat, a mineral or mineral source, a vitamin, a supplement, an organism, a pharmaceutical, and an excipient. In some embodiments the second component is a protein. In some embodiments the protein is a nutritive protein. In some embodiments the second component is a free amino acid selected from essential amino acids, non-essential amino acids, branch chain amino acids, non-standard amino acids and modified amino acids. In some embodiments the at least one second component is a free amino acid selected from essential amino acids. In some embodiments the second component is a free amino acid selected from branch chain amino acids. In some embodiments the second component is a free amino acid selected from non-essential amino acids. In some embodiments the at least one second component is Leu. In some embodiments the at least one second component is a lipid. In some embodiments the lipid is selected from a fat, oil, triglyceride, cholesterol, phospholipid, and fatty acid. In some embodiments the at least one second component is selected from a mineral and a vitamin. In some embodiments the at least one second component is a supplement. In some embodiments the at least one second component is an organism. In some embodiments the at least one second component is a pharmaceutical. In some embodiments the second component is an excipient. In some embodiments the excipient is selected from a buffering agent, a preservative, a stabilizer, a binder, a compaction agent, a lubricant, a dispersion enhancer, a disintegration agent, a flavoring agent, a sweetener, a coloring agent. In some embodiments the nutritive composition is formulated as a liquid solution, slurry, suspension, gel, paste, powder, or solid.

In another aspect this disclosure provides methods of making a nutritive composition, comprising providing a nutritive protein of this disclosure and combining the nutritive protein with the at least one second component.

In another aspect this disclosure provides methods of maintaining or increasing of muscle mass, muscle strength, and functional performance in a subject, the method comprising providing to the subject a sufficient amount of a nutritive protein of this disclosure, a nutritive composition of this disclosure, or a nutritive composition made by a method of this disclosure. In some embodiments the subject is of elderly, critically-medically ill, and suffering from protein-energy malnutrition. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, a nutritive composition of this disclosure, or a nutritive composition made by a method of this disclosure is consumed by the subject by an oral, enteral, or parenteral route.

In another aspect this disclosure provides methods of maintaining or achieving a desirable body mass index in a subject, the method comprising providing to the subject a sufficient amount of a nutritive protein of this disclosure, a nutritive composition of this disclosure, or a nutritive composition made by a method of this disclosure. In some embodiments the subject is of elderly, critically-medically ill, and suffering from protein-energy malnutrition. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, a nutritive composition of this disclosure, or a nutritive composition made by a method of this disclosure is consumed by the subject by an oral, enteral, or parenteral route.

In another aspect this disclosure provides methods of treating cachexia in a subject, the method comprising providing to the subject a sufficient amount of a nutritive protein of this disclosure, a nutritive composition of this disclosure, or a nutritive composition made by a method of this disclosure. In some embodiments the subject is of elderly, critically-medically ill, and suffering from protein-energy malnutrition. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, a nutritive composition of this disclosure, or a nutritive composition made by a method of this disclosure is consumed by the subject by an oral, enteral, or parenteral route.

In another aspect this disclosure provides methods of providing protein to a subject with protein-energy malnutrition, the method comprising providing to the subject a sufficient amount of a nutritive protein of this disclosure, a nutritive composition of this disclosure, or a nutritive composition made by a method of this disclosure. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, a nutritive composition of this disclosure, or a nutritive composition made by a method of this disclosure is consumed by the subject by an oral, enteral, or parenteral route.

In another aspect this disclosure provides methods of increasing thermogenesis in a subject, the method comprising providing to the subject a sufficient amount of a nutritive protein of this disclosure, a nutritive composition of this disclosure, or a nutritive composition made by a method of this disclosure. In some embodiments the subject is obese. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, a nutritive composition of this disclosure, or a nutritive composition made by a method of this disclosure is consumed by the subject by an oral, enteral, or parenteral route.

In another aspect this disclosure provides methods of inducing at least one of a satiation response and a satiety response in a subject, the method comprising providing to the subject a sufficient amount of a nutritive protein of this disclosure, a nutritive composition of this disclosure, or a nutritive composition made by a method of this disclosure. In some embodiments the subject is obese. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, a nutritive composition of this disclosure, or a nutritive composition made by a method of this disclosure is consumed by the subject by an oral, enteral, or parenteral route.

In another aspect this disclosure provides methods of treating at least one of cachexia, sarcopenia and frailty in a subject, the method comprising providing to the subject a sufficient amount of a nutritive protein of this disclosure, a nutritive composition of this disclosure, or a nutritive composition made by a method of this disclosure. In some embodiments the nutritive protein of this disclosure, a nutritive composition of this disclosure, or a nutritive composition made by a method of this disclosure is consumed by the subject by an oral, enteral, or parenteral route.

DETAILED DESCRIPTION

Figure 1:
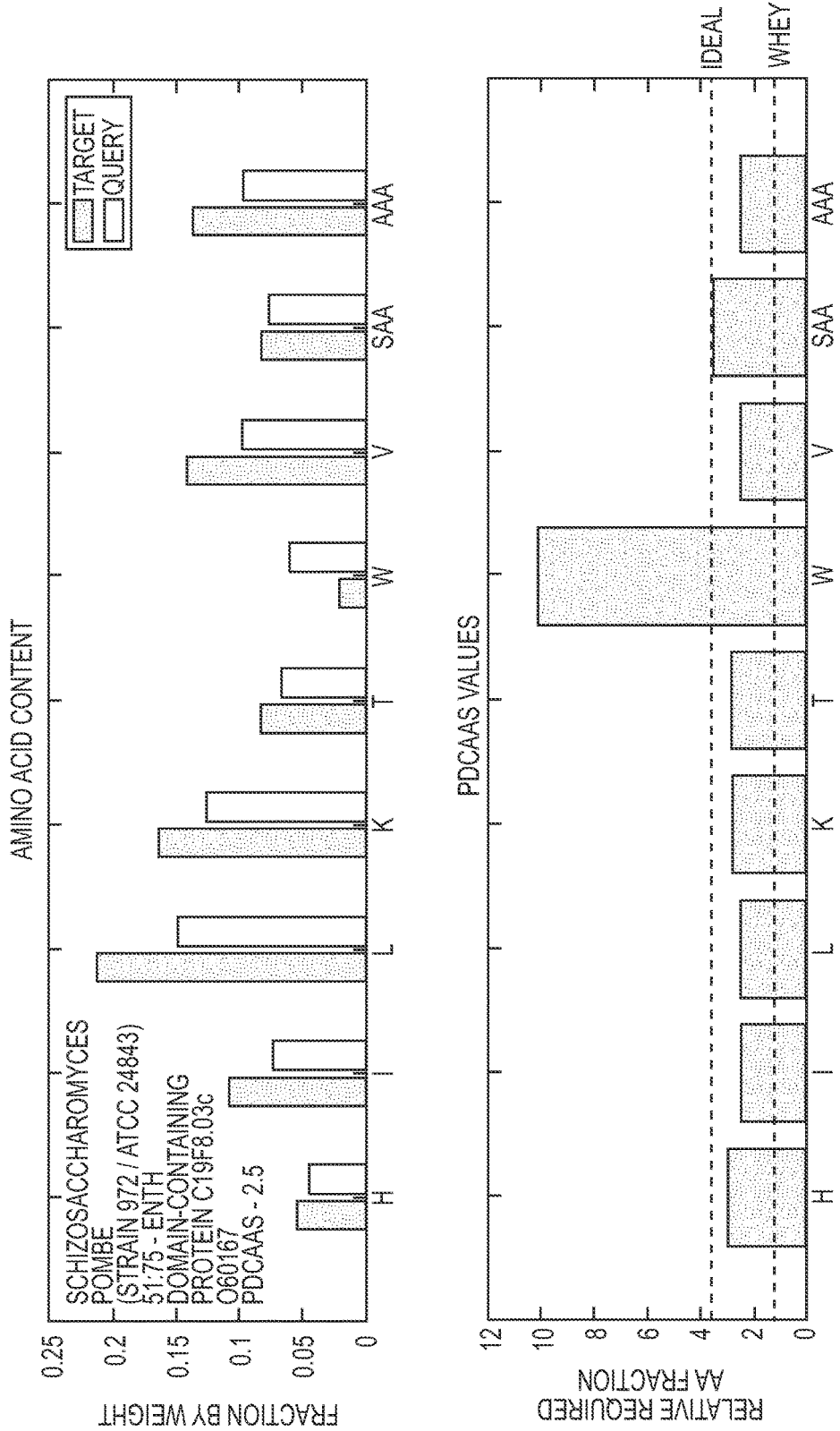
FIG. 1 shows the essential amino acid content of the polypeptide fragment from amino acid 51 to amino acid 75 of the *Schizosaccharomyces pombe* ENTH domain-containing protein C19F8.03c protein (UniProt O60167) (SEQ ID NO: 415), which has a PDCAAS score of 2.5. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

Unless otherwise defined herein, scientific and technical terms used in connection with the present disclosure shall have the meanings that are commonly understood by those of ordinary skill in the art. Further, unless otherwise required by context, singular terms shall include the plural and plural terms shall include the singular. Generally, nomenclatures used in connection with, and techniques of, biochemistry, enzymology, molecular and cellular biology, microbiology, genetics and protein and nucleic acid chemistry and hybridization described herein are those well-known and commonly used in the art. Certain references and other documents cited herein are expressly incorporated herein by reference. Additionally, all UniProt/SwissProt records cited herein are hereby incorporated herein by reference. In case of conflict, the present specification, including definitions, will control. The materials, methods, and examples are illustrative only and not intended to be limiting.

The methods and techniques of the present disclosure are generally performed according to conventional methods well known in the art and as described in various general and more specific references that are cited and discussed throughout the present specification unless otherwise indicated. See, e.g., Sambrook et al., Molecular Cloning: A Laboratory Manual, 3d ed., Cold Spring Harbor Laboratory Press, Cold Spring Harbor, N.Y. (2001); Ausubel et al., Current Protocols in Molecular Biology, Greene Publishing Associates (1992, and Supplements to 2002); Taylor and Drickamer, Introduction to Glycobiology, Oxford Univ. Press (2003); Worthington Enzyme Manual, Worthington Biochemical Corp., Freehold, N.J.; Handbook of Biochemistry: Section A Proteins, Vol I, CRC Press (1976); Handbook of Biochemistry: Section A Proteins, Vol II, CRC Press (1976); Essentials of Glycobiology, Cold Spring Harbor Laboratory Press (1999). Many molecular biology and genetic techniques applicable to cyanobacteria are described in Heidorn et al., "Synthetic Biology in Cyanobacteria: Engineering and Analyzing Novel Functions," Methods in Enzymology, Vol. 497, Ch. 24 (2011), which is hereby incorporated herein by reference.

This disclosure refers to sequence database entries (e.g., UniProt/SwissProt records) for certain protein and gene sequences that are published on the internet, as well as other information on the internet. The skilled artisan understands that information on the internet, including sequence database entries, is updated from time to time and that, for example, the reference number used to refer to a particular sequence can change. Where reference is made to a public database of sequence information or other information on the internet, it is understood that such changes can occur and particular embodiments of information on the internet can come and go. Because the skilled artisan can find equivalent information by searching on the internet, a reference to an internet web page address or a sequence database entry evidences the availability and public dissemination of the information in question.

Before the present proteins, compositions, methods, and other embodiments are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise.

The term "comprising" as used herein is synonymous with "including" or "containing", and is inclusive or open-ended and does not exclude additional, unrecited members, elements or method steps.

This disclosure makes reference to amino acids. The full name of the amino acids is used interchangeably with the standard three letter and one letter abbreviations for each. For the avoidance of doubt, those are: Alanine (Ala, A), Arginine (Arg, R), Asparagine (Asn, N), Aspartic acid (Asp, D), Cysteine (Cys, C), Glutamic Acid (Glu, E), Glutamine (Gln, Q), Glycine (Gly, G), Histidine (H is, H), Isoleucine (Ile, I), Leucine (Leu, L), Lysine (Lys, K), Methionine (Met, M), Phenylalanine (Phe, F), Proline (Pro, P), Serine (Ser, S), Threonine (Thr, T), Tryptophan (Trp, W), Tyrosine (Tyr, Y), Valine (Val, V).

As used herein, the term "in vitro" refers to events that occur in an artificial environment, e.g., in a test tube or reaction vessel, in cell culture, in a Petri dish, etc., rather than within an organism (e.g., animal, plant, or microbe).

As used herein, the term "in vivo" refers to events that occur within an organism (e.g., animal, plant, or microbe).

As used herein, the term "isolated" refers to a substance or entity that has been (1) separated from at least some of the components with which it was associated when initially produced (whether in nature or in an experimental setting), and/or (2) produced, prepared, and/or manufactured by the hand of man. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

As used herein, a "branch chain amino acid" is an amino acid selected from Leucine, Isoleucine, and Valine.

As used herein, an "essential amino acid" (EAA) is an amino acid selected from H, I, L, K, M, F, T, W, and V.

As used herein, a "non-essential amino acid" (NEAA) is an amino acid selected from A, R, N, D, Q, E, G, P, and S.

As used herein, a "conditionally essential amino acid" (CEAA) is an amino acid selected from C and Y.

As used herein, an "aromatic amino acid" (AAA) is an amino acid selected from F and Y.

As used herein, a "sulphur-containing amino acid" (SAA) is an amino acid selected from M and C.

The term "peptide" as used herein refers to a short polypeptide, e.g., one that typically contains less than about 50 amino acids and more typically less than about 30 amino acids. The term as used herein encompasses analogs and mimetics that mimic structural and thus biological function.

The term "polypeptide" encompasses both naturally-occurring and non-naturally occurring proteins, and fragments, mutants, derivatives and analogs thereof. A polypeptide may be monomeric or polymeric. Further, a polypeptide may comprise a number of different domains each of which has one or more distinct activities. For the avoidance of doubt, a "polypeptide" may be any length greater two amino acids.

The term "isolated protein" or "isolated polypeptide" is a protein or polypeptide that by virtue of its origin or source of derivation (1) is not associated with naturally associated components that accompany it in its native state, (2) exists in a purity not found in nature, where purity can be adjudged with respect to the presence of other cellular material (e.g., is free of other proteins from the same species) (3) is expressed by a cell from a different species, or (4) does not occur in nature (e.g., it is a fragment of a polypeptide found in nature or it includes amino acid analogs or derivatives not found in nature or linkages other than standard peptide bonds). Thus, a polypeptide that is chemically synthesized or synthesized in a cellular system different from the cell from which it naturally originates will be "isolated" from its naturally associated components. A polypeptide or protein may also be rendered substantially free of naturally associated components by isolation, using protein purification techniques well known in the art. As thus defined, "isolated" does not necessarily require that the protein, polypeptide, peptide or oligopeptide so described has been physically removed from a cell in which it was synthesized.

The term "polypeptide fragment" as used herein refers to a polypeptide that has a deletion, e.g., an amino-terminal and/or carboxy-terminal deletion compared to a full-length polypeptide, such as a naturally occurring protein. In an embodiment, the polypeptide fragment is a contiguous sequence in which the amino acid sequence of the fragment is identical to the corresponding positions in the naturally-occurring sequence. Fragments typically are at least 5, 6, 7, 8, 9 or 10 amino acids long, or at least 12, 14, 16 or 18 amino acids long, or at least 20 amino acids long, or at least 25, 30, 35, 40 or 45, amino acids, or at least 50 or 60 amino acids long, or at least 70 amino acids long, or at least 100 amino acids long.

The term "fusion protein" refers to a polypeptide comprising a polypeptide or fragment coupled to heterologous amino acid sequences. Fusion proteins are useful because they can be constructed to contain two or more desired functional elements that can be from two or more different proteins. A fusion protein comprises at least 10 contiguous amino acids from a polypeptide of interest, or at least 20 or 30 amino acids, or at least 40, 50 or 60 amino acids, or at least 75, 100 or 125 amino acids. The heterologous polypeptide included within the fusion protein is usually at least 6 amino acids in length, or at least 8 amino acids in length, or at least 15, 20, or 25 amino acids in length. Fusions that include larger polypeptides, such as an IgG Fc region, and even entire proteins, such as the green fluorescent protein ("GFP") chromophore-containing proteins, have particular utility. Fusion proteins can be produced recombinantly by constructing a nucleic acid sequence which encodes the polypeptide or a fragment thereof in frame with a nucleic acid sequence encoding a different protein or peptide and then expressing the fusion protein. Alternatively, a fusion protein can be produced chemically by crosslinking the polypeptide or a fragment thereof to another protein.

As used herein, a protein has "homology" or is "homologous" to a second protein if the nucleic acid sequence that encodes the protein has a similar sequence to the nucleic acid sequence that encodes the second protein. Alternatively, a protein has homology to a second protein if the two proteins have similar amino acid sequences. (Thus, the term "homologous proteins" is defined to mean that the two proteins have similar amino acid sequences.) As used herein, homology between two regions of amino acid sequence (especially with respect to predicted structural similarities) is interpreted as implying similarity in function.

When "homologous" is used in reference to proteins or peptides, it is recognized that residue positions that are not identical often differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of homology may be adjusted upwards to correct for the conservative nature of the substitution. Means for making this adjustment are well known to those of skill in the art. See, e.g., Pearson, 1994, Methods Mol. Biol. 24:307-31 and 25:365-89.

The following six groups each contain amino acids that are conservative substitutions for one another: 1) Serine, Threonine; 2) Aspartic Acid, Glutamic Acid; 3) Asparagine, Glutamine; 4) Arginine, Lysine; 5) Isoleucine, Leucine, Methionine, Alanine, Valine, and 6) Phenylalanine, Tyrosine, Tryptophan.

Sequence homology for polypeptides, which is also referred to as percent sequence identity, is typically measured using sequence analysis software. See, e.g., the Sequence Analysis Software Package of the Genetics Computer Group (GCG), University of Wisconsin Biotechnology Center, 910 University Avenue, Madison, Wis. 53705. Protein analysis software matches similar sequences using a measure of homology assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild-type protein and a mutein thereof. See, e.g., GCG Version 6.1.

An exemplary algorithm when comparing a particular polypeptide sequence to a database containing a large number of sequences from different organisms is the computer program BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

Exemplary parameters for BLASTp are: Expectation value: 10 (default); Filter: seg (default); Cost to open a gap: 11 (default); Cost to extend a gap: 1 (default); Max. alignments: 100 (default); Word size: 11 (default); No. of descriptions: 100 (default); Penalty Matrix: BLOWSUM62. The length of polypeptide sequences compared for homology will generally be at least about 16 amino acid residues, or at least about 20 residues, or at least about 24 residues, or at least about 28 residues, or more than about 35 residues. When searching a database containing sequences from a large number of different organisms, it may be useful to compare amino acid sequences. Database searching using amino acid sequences can be measured by algorithms other than blastp known in the art. For instance, polypeptide sequences can be compared using FASTA, a program in GCG Version 6.1. FASTA provides alignments and percent sequence identity of the regions of the best overlap between the query and search sequences. Pearson, Methods Enzymol. 183:63-98 (1990). For example, percent sequence identity between amino acid sequences can be determined using FASTA with its default parameters (a word size of 2 and the PAM250 scoring matrix), as provided in GCG Version 6.1, herein incorporated by reference.

In some embodiments, polymeric molecules (e.g., a polypeptide sequence or nucleic acid sequence) are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% similar. The term "homologous" necessarily refers to a comparison between at least two sequences (nucleotides sequences or amino acid sequences). In some embodiments, two nucleotide sequences are considered to be homologous if the polypeptides they encode are at least about 50% identical, at least about 60% identical, at least about 70% identical, at least about 80% identical, or at least about 90% identical for at least one stretch of at least about 20 amino acids. In some embodiments, homologous nucleotide sequences are characterized by the ability to encode a stretch of at least 4-5 uniquely specified amino acids. Both the identity and the approximate spacing of these amino acids relative to one another must be considered for nucleotide sequences to be considered homologous. In some embodiments of nucleotide sequences less than 60 nucleotides in length, homology is determined by the ability to encode a stretch of at least 4-5 uniquely specified amino acids. In some embodiments, two protein sequences are considered to be homologous if the proteins are at least about 50% identical, at least about 60% identical, at least about 70% identical, at least about 80% identical, or at least about 90% identical for at least one stretch of at least about 20 amino acids.

As used herein, a "modified derivative" refers to polypeptides or fragments thereof that are substantially homologous in primary structural sequence to a reference polypeptide sequence but which include, e.g., in vivo or in vitro chemical and biochemical modifications or which incorporate amino acids that are not found in the reference polypeptide. Such modifications include, for example, acetylation, carboxylation, phosphorylation, glycosylation, ubiquitination, labeling, e.g., with radionuclides, and various enzymatic modifications, as will be readily appreciated by those skilled in the art. A variety of methods for labeling polypeptides and of substituents or labels useful for such purposes are well known in the art, and include radioactive isotopes such as $^{125}I$, $^{32}P$, $^{35}S$, and $^{3}H$, ligands that bind to labeled antiligands (e.g., antibodies), fluorophores, chemiluminescent agents, enzymes, and antiligands that can serve as specific binding pair members for a labeled ligand. The choice of label depends on the sensitivity required, ease of conjugation with the primer, stability requirements, and available instrumentation. Methods for labeling polypeptides are well known in the art. See, e.g., Ausubel et al., Current Protocols in Molecular Biology, Greene Publishing Associates (1992, and Supplements to 2002).

As used herein, "polypeptide mutant" or "mutein" refers to a polypeptide whose sequence contains an insertion, duplication, deletion, rearrangement or substitution of one or more amino acids compared to the amino acid sequence of a reference protein or polypeptide, such as a native or wild-type protein. A mutein may have one or more amino acid point substitutions, in which a single amino acid at a position has been changed to another amino acid, one or more insertions and/or deletions, in which one or more amino acids are inserted or deleted, respectively, in the sequence of the reference protein, and/or truncations of the amino acid sequence at either or both the amino or carboxy termini. A mutein may have the same or a different biological activity compared to the reference protein.

In some embodiments, a mutein has, for example, at least 85% overall sequence homology to its counterpart reference protein. In some embodiments, a mutein has at least 90% overall sequence homology to the wild-type protein. In other embodiments, a mutein exhibits at least 95% sequence identity, or 98%, or 99%, or 99.5% or 99.9% overall sequence identity.

As used herein, a "polypeptide tag for affinity purification" is any polypeptide that has a binding partner that can be used to isolate or purify a second protein or polypeptide sequence of interest fused to the first "tag" polypeptide. Several examples are well known in the art and include a His-6 tag, a FLAG epitope, a c-myc epitope, a Strep-TAGII, a biotin tag, a glutathione 5-transferase (GST), a chitin binding protein (CBP), a maltose binding protein (MBP), or a metal affinity tag.

As used herein, "recombinant" refers to a biomolecule, e.g., a gene or protein, that (1) has been removed from its naturally occurring environment, (2) is not associated with all or a portion of a polynucleotide in which the gene is found in nature, (3) is operatively linked to a polynucleotide which it is not linked to in nature, or (4) does not occur in nature. The term "recombinant" can be used in reference to cloned DNA isolates, chemically synthesized polynucleotide analogs, or polynucleotide analogs that are biologically synthesized by heterologous systems, as well as proteins and/or mRNAs encoded by such nucleic acids. Thus, for example, a protein synthesized by a microorganism is recombinant, for example, if it is synthesized from an mRNA synthesized from a recombinant gene present in the cell.

The term "polynucleotide", "nucleic acid molecule", "nucleic acid", or "nucleic acid sequence" refers to a polymeric form of nucleotides of at least 10 bases in length. The term includes DNA molecules (e.g., cDNA or genomic or synthetic DNA) and RNA molecules (e.g., mRNA or synthetic RNA), as well as analogs of DNA or RNA containing non-natural nucleotide analogs, non-native internucleoside bonds, or both. The nucleic acid can be in any topological conformation. For instance, the nucleic acid can be single-stranded, double-stranded, triple-stranded, quadruplexed, partially double-stranded, branched, hairpinned, circular, or in a padlocked conformation. The nucleic acid (also referred to as polynucleotides) may include both sense and antisense strands of RNA, cDNA, genomic DNA, and synthetic forms and mixed polymers of the above. They may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.) Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule. Other modifications can include, for example, analogs in which the ribose ring contains a bridging moiety or other structure such as the modifications found in "locked" nucleic acids.

A "synthetic" RNA, DNA or a mixed polymer is one created outside of a cell, for example one synthesized chemically.

The term "nucleic acid fragment" as used herein refers to a nucleic acid sequence that has a deletion, e.g., a 5'-terminal or 3'-terminal deletion compared to a full-length reference nucleotide sequence. In an embodiment, the nucleic acid fragment is a contiguous sequence in which the nucleotide sequence of the fragment is identical to the corresponding positions in the naturally-occurring sequence. In some embodiments fragments are at least 10, 15, 20, or 25 nucleotides long, or at least 20, 30, 40, 50, 60, 70, 80, 90, 100, 110, 120, 130, 140, or 150 nucleotides long. In some embodiments a fragment of a nucleic acid sequence is a fragment of an open reading frame sequence. In some embodiments such a fragment encodes a polypeptide fragment (as defined herein) of the protein encoded by the open reading frame nucleotide sequence.

As used herein, an endogenous nucleic acid sequence in the genome of an organism (or the encoded protein product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous (originating from the same host cell or progeny thereof) or exogenous (originating from a different host cell or progeny thereof). By way of example, a promoter sequence can be substituted (e.g., by homologous recombination) for the native promoter of a gene in the genome of a host cell, such that this gene has an altered expression pattern. This gene would now become "recombinant" because it is separated from at least some of the sequences that naturally flank it.

A nucleic acid is also considered "recombinant" if it contains any modifications that do not naturally occur to the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

As used herein, the phrase "degenerate variant" of a reference nucleic acid sequence encompasses nucleic acid sequences that can be translated, according to the standard genetic code, to provide an amino acid sequence identical to that translated from the reference nucleic acid sequence. The term "degenerate oligonucleotide" or "degenerate primer" is used to signify an oligonucleotide capable of hybridizing with target nucleic acid sequences that are not necessarily identical in sequence but that are homologous to one another within one or more particular segments.

The term "percent sequence identity" or "identical" in the context of nucleic acid sequences refers to the residues in the two sequences which are the same when aligned for maximum correspondence. The length of sequence identity comparison may be over a stretch of at least about nine nucleotides, usually at least about 20 nucleotides, more usually at least about 24 nucleotides, typically at least about 28 nucleotides, more typically at least about 32, and even more typically at least about 36 or more nucleotides. There are a number of different algorithms known in the art which can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990). For instance, percent sequence identity between nucleic acid sequences can be determined using FASTA with its default parameters (a word size of 6 and the NOPAM factor for the scoring matrix) or using Gap with its default parameters as provided in GCG Version 6.1, herein incorporated by reference. Alternatively, sequences can be compared using the computer program, BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% or 99% of the nucleotide bases, as measured by any well-known algorithm of sequence identity, such as FASTA, BLAST or Gap, as discussed above.

Alternatively, substantial homology or similarity exists when a nucleic acid or fragment thereof hybridizes to another nucleic acid, to a strand of another nucleic acid, or to the complementary strand thereof, under stringent hybridization conditions. "Stringent hybridization conditions" and "stringent wash conditions" in the context of nucleic acid hybridization experiments depend upon a number of different physical parameters. Nucleic acid hybridization will be affected by such conditions as salt concentration, temperature, solvents, the base composition of the hybridizing species, length of the complementary regions, and the number of nucleotide base mismatches between the hybridizing nucleic acids, as will be readily appreciated by those skilled in the art. One having ordinary skill in the art knows how to vary these parameters to achieve a particular stringency of hybridization.

In general, "stringent hybridization" is performed at about 25° C. below the thermal melting point (Tm) for the specific DNA hybrid under a particular set of conditions. "Stringent washing" is performed at temperatures about 5° C. lower than the Tm for the specific DNA hybrid under a particular set of conditions. The Tm is the temperature at which 50% of the target sequence hybridizes to a perfectly matched probe. See Sambrook et al., Molecular Cloning: A Laboratory Manual, 2d ed., Cold Spring Harbor Laboratory Press, Cold Spring Harbor, N.Y. (1989), page 9.51. For purposes herein, "stringent conditions" are defined for solution phase hybridization as aqueous hybridization (i.e., free of formamide) in 6×SSC (where 20×SSC contains 3.0 M NaCl and 0.3 M sodium citrate), 1% SDS at 65° C. for 8-12 hours, followed by two washes in 0.2×SSC, 0.1% SDS at 65° C. for 20 minutes. It will be appreciated by the skilled worker that hybridization at 65° C. will occur at different rates depending on a number of factors including the length and percent identity of the sequences which are hybridizing.

As used herein, an "expression control sequence" refers to polynucleotide sequences which are necessary to affect the expression of coding sequences to which they are operatively linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence. The term "control sequences" is intended to encompass, at a minimum, any component whose presence is essential for expression, and can also encompass an additional component whose presence is advantageous, for example, leader sequences and fusion partner sequences.

As used herein, "operatively linked" or "operably linked" expression control sequences refers to a linkage in which the expression control sequence is contiguous with the gene of interest to control the gene of interest, as well as expression control sequences that act in trans or at a distance to control the gene of interest.

As used herein, a "vector" is intended to refer to a nucleic acid molecule capable of transporting another nucleic acid to which it has been linked. One type of vector is a "plasmid," which generally refers to a circular double stranded DNA loop into which additional DNA segments may be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments may be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain vectors are capable of directing the expression of genes to which they are operatively linked. Such vectors are referred to herein as "recombinant expression vectors" (or simply "expression vectors").

The term "recombinant host cell" (or simply "recombinant cell" or "host cell"), as used herein, is intended to refer to a cell into which a recombinant nucleic acid such as a recombinant vector has been introduced. In some instances the word "cell" is replaced by a name specifying a type of cell. For example, a "recombinant microorganism" is a recombinant host cell that is a microorganism host cell. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "recombinant host cell," "recombinant cell," and "host cell," as used herein. A recombinant host cell may be an isolated cell or cell line grown in culture or may be a cell which resides in a living tissue or organism.

As used herein, the term "heterotrophic" refers to an organism that cannot fix carbon and uses organic carbon for growth.

As used herein, the term "autotrophic" refers to an organism that produces complex organic compounds (such as carbohydrates, fats, and proteins) from simple inorganic molecules using energy from light (by photosynthesis) or inorganic chemical reactions (chemosynthesis).

As used herein, "muscle mass" refers to the weight of muscle in a subject's body. Muscle mass includes the skeletal muscles, smooth muscles (such as cardiac and digestive muscles) and the water contained in these muscles. Muscle mass of specific muscles can be determined using dual energy x-ray absorptiometry (DEXA) (Padden-Jones et al., 2004). Total lean body mass (minus the fat), total body mass, and bone mineral content can be measured by DEXA as well. In some embodiments a change in the muscle mass of a specific muscle of a subject is determined, for example by DEXA, and the change is used as a proxy for the total change in muscle mass of the subject. Thus, for example, if a subject consumes a nutritive protein as disclosed herein and experiences an increase over a period of time in muscle mass in a particular muscle or muscle group, it can be concluded that the subject has experienced an increase in muscle mass.

As used herein, a "muscle strength" refers to the amount of force a muscle can produce with a single maximal effort. There are two types of muscle strength, static strength and dynamic strength. Static strength refers to isometric contraction of a muscle, where a muscle generates force while the muscle length remains constant and/or when there is no movement in a joint. Examples include holding or carrying an object, or pushing against a wall. Dynamic strength refers to a muscle generating force that results in movement. Dynamic strength can be isotonic contraction, where the muscle shortens under a constant load or isokinetic contraction, where the muscle contracts and shortens at a constant speed. Dynamic strength can also include isoinertial strength.

Unless specified, "muscle strength" refers to maximum dynamic muscle strength. Maximum strength is referred to as "one repetition maximum" (1RM). This is a measurement of the greatest load (in kilograms) that can be fully moved (lifted, pushed or pulled) once without failure or injury. This value can be measured directly, but doing so requires that the weight is increased until the subject fails to carry out the activity to completion. Alternatively, 1RM is estimated by counting the maximum number of exercise repetitions a subject can make using a load that is less than the maximum amount the subject can move. Leg extension and leg flexion are often measured in clinical trials (Borsheim et al., "Effect of amino acid supplementation on muscle mass, strength and physical function in elderly," Clin Nutr 2008; 27:189-195; Paddon-Jones, et al., "Essential amino acid and carbohydrate supplementation ameliorates muscle protein loss in humans during 28 days bed rest," J Clin Endocrinol Metab 2004; 89:4351-4358).

As used herein, "functional performance" refers to a functional test that simulates daily activities. "Functional performance" is measured by any suitable accepted test, including timed-step test (step up and down from a 4 inch bench as fast as possible 5 times), timed floor transfer test (go from a standing position to a supine position on the floor and thereafter up to a standing position again as fast as possible for one repetition), and physical performance battery test (static balance test, chair test, and a walking test) (Borsheim et al., "Effect of amino acid supplementation on muscle mass, strength and physical function in elderly," Clin Nutr 2008; 27:189-195).

As used herein, a "body mass index" or "BMI" or "Quetelet index" is a subject's weight in kilograms divided by the square of the subject's height in meters ($kg/m^2$).

For adults, a frequent use of the BMI is to assess how much an individual's body weight departs from what is normal or desirable for a person of his or her height. The weight excess or deficiency may, in part, be accounted for by body fat, although other factors such as muscularity also affect BMI significantly. The World Health Organization regards a BMI of less than 18.5 as underweight and may indicate malnutrition, an eating disorder, or other health problems, while a BMI greater than 25 is considered overweight and above 30 is considered obese. (World Health Organization. BMI classification. Accessed Mar. 19, 2012 http://apps.who.int/bmi/index.jsp?introPage=intro_3.html.)

As used herein a "desirable body mass index" is a body mass index of from about 18.5 to about 25. Thus, if a subject has a BMI below about 18.5, then an increase in the subject's BMI is an increase in the desirability of the subject's BMI.

If instead a subject has a BMI above about 25, then a decrease in the subject's BMI is an increase in the desirability of the subject's BMI.

As used herein, an "elderly" mammal is one who experiences age related changes in at least one of body mass index and muscle mass (e.g., age related sarcopenia). In some embodiments an "elderly" human is at least 50 years old, at least 60 years old, at least 65 years old, at least 70 years old, at least 75 years old, at least 80 years old, at least 85 years old, at least 90 years old, at least 95 years old, or at least 100 years old. In some embodiments and an elderly animal, mammal, or human is a human who has experienced a loss of muscle mass from peak lifetime muscle mass of at least 5%, at least 10%, at least 15%, at least 20%, at least 25%, at least 30%, at least 35%, at least 40%, at least 45%, at least 50%, at least 55%, or at least 60%. Because age related changes to at least one of body mass index and muscle mass are known to correlate with increasing age, in some embodiments an elderly mammal is identified or defined simply on the basis of age. Thus, in some embodiments an "elderly" human is identified or defined simply by the fact that their age is at least 60 years old, at least 65 years old, at least 70 years old, at least 75 years old, at least 80 years old, at least 85 years old, at least 90 years old, at least 95 years old, or at least 100 years old, and without recourse to a measurement of at least one of body mass index and muscle mass.

As used herein, a patient is "critically-medically ill" if the patient, because of medical illness, experiences changes in at least one of body mass index and muscle mass (e.g., sarcopenia). In some embodiments the patient is confined to bed for at least 25%, at least 50%, at least 60%, at least 70%, at least 80%, at least 90%, at least 95%, or 100% of their waking time. In some embodiments the patient is unconscious. In some embodiments the patient has been confined to bed as described in this paragraph for at least 1 day, 2 days, 3 days, 4 days, 5 days, 10 days, 2 weeks, 3 weeks, 4 weeks, 5 weeks, 10 weeks or longer.

As used herein, "protein-energy malnutrition" refers to a form of malnutrition where there is inadequate protein intake. Types include Kwashiorkor (protein malnutrition predominant), Marasmus (deficiency in both calorie and protein nutrition), and Marasmic Kwashiorkor (marked protein deficiency and marked calorie insufficiency signs present, sometimes referred to as the most severe form of malnutrition).

As used herein, "cachexia" refers to a multifaceted clinical syndrome that results in wasting and weight loss. It is a complex condition where protein catabolism exceeds protein anabolism, which makes muscle wasting a primary feature of the condition. In addition to the metabolic derangements in protein metabolism, it is also characterized by anorexia and inflammation. These derangements plus impaired protein metabolism are responsive to nutrition therapy to varying degrees.

As used herein, "thermogenesis" is the process of heat production in a mammal. Thermogenesis is accompanied by an increase in energy expenditure. Thermogenesis is specifically the energy burned following the metabolism of a food component (such as protein). This may also be referred to as the thermic effect of food. Total energy expenditure by an individual equals the sum of resting energy expenditure (energy consumed at rest in a fasting state to support basal metabolism), the thermic effect of food, and energy expenditure related to physical activity. Resting energy expenditure accounts for about 65-75% of total energy expenditure in humans. The amount and activity of muscle mass is one influencer of resting energy expenditure. Adequate protein consumption to support muscle also influences resting energy expenditure. The ingestion of protein tends to increase energy expenditure following a meal; this is the thermic effect of food. The thermic effect of food accounts for about 10% of total energy expenditure in humans. While this is a small proportion of total energy expenditure, small increases in this value can impact body weight. Protein has a higher thermic effect than fat or carbohydrate; this effect along with other metabolic influences of protein make it a useful substrate for weight control, diabetes management and other conditions.

As used herein, "satiation" is the act of becoming full while eating or a reduced desire to eat. This halts or diminishes eating.

As used herein, "satiety" is the act of remaining full after a meal which manifests as the period of no eating follow the meal.

As used herein, "exercise" is, most broadly, any bodily activity that enhances or maintains physical fitness and overall health and wellness. Exercise is performed for various reasons including strengthening muscles and the cardiovascular system, honing athletic skills, weight loss or maintenance, as well as for the purpose of enjoyment.

As used herein, a "sufficient amount" is an amount of a protein or polypeptide disclosed herein that is sufficient to cause a desired effect. For example, if an increase in muscle mass is desired, a sufficient amount is an amount that causes an increase in muscle mass in a subject over a period of time. A sufficient amount of a protein or polypeptide fragment can be provided directly, i.e., by administering the protein or polypeptide fragment to a subject, or it can be provided as part of a composition comprising the protein or polypeptide fragment. Modes of administration are discussed elsewhere herein.

As used herein, the term "mammal" refers to any member of the taxonomic class mammalia, including placental mammals and marsupial mammals. Thus, "mammal" includes humans, primates, livestock, and laboratory mammals. Exemplary mammals include a rodent, a mouse, a rat, a rabbit, a dog, a cat, a sheep, a horse, a goat, a llama, cattle, a primate, a pig, and any other mammal. In some embodiments, the mammal is at least one of a transgenic mammal, a genetically-engineered mammal, and a cloned mammal.

A. Nutritive Proteins

For the purposes of this disclosure, a "nutritive protein" is a protein that contains a desirable amount of essential amino acids. In some embodiments, the nutritive protein comprises at least 30% essential amino acids by weight. In some embodiments, the nutritive protein comprises at least 40% essential amino acids by weight. In some embodiments, the nutritive protein comprises at least 50% essential amino acids by weight. In some embodiments the nutritive protein comprises or consists of a protein or fragment of a protein that naturally occurs in an edible species. In its broadest sense, an "edible species" encompasses any species known to be eaten without deleterious effect by at least one type of mammal. A deleterious effect includes a poisonous effect and a toxic effect. In some embodiments an edible species is a species known to be eaten by humans without deleterious effect. Some edible species are an infrequent but known component of the diet of only a small group of a type of mammal in a limited geographic location while others are a dietary staple throughout much of the world. In other embodiments an edible species is one not known to be previously eaten by any mammal, but that is demonstrated to be edible upon testing. Edible species include but are not limited to *Gossypium turneri, Pleurotus cornucopiae, Glycine max, Oryza sativa, Thunnus obesus, Abies bracteata, Acomys ignitus, Lathyrus aphaca, Bos gaurus, Raphicerus melanotis, Phoca groenlandica, Acipenser sinensis, Viverra tangalunga, Pleurotus sajor-caju, Fagopyrum tataricum, Pinus strobus, Ipomoea nil, Taxus cuspidata, Ipomoea wrightii, Mya arenaria, Actinidia deliciosa, Gazella granti, Populus tremula, Prunus domestica, Larus argentatus, Vicia villosa, Sargocentron punctatissimum, Silene latifolia, Lagenodelphis hosei, Spisula solidissima, Crossarchus obscurus, Phaseolus angularis, Lathyrus vestitus, Oncorhynchus gorbuscha, Alligator mississippiensis, Pinus halepensis, Larus canus, Brassica napus, Silene cucubalus, Phoca fasciata, Gazella bennettii, Pinus taeda, Taxus canadensis, Zamia furfuracea, Pinus yunnanensis, Pinus wallichiana, Asparagus officinalis, Capsicum baccatum, Pinus longaeva, Taxus baccata, Pinus sibirica, Citrus sinensis, Sargocentron xantherythrum, Bison bison, Gazella thomsonii, Vicia sativa, Branta canadensis, Apium graveolens, Acer campestre, Coriandrum sativum, Silene conica, Lactuca sativa, Capsicum chinense, Abies veitchii, Capra hircus, Gazella spekei, Oncorhynchus keta, Ipomoea obscura, Cucumis melo* var. *conomon, Phoca hispida, Vulpes vulpes, Ipomoea quamoclit, Solanum habrochaites, Populus*sp., *Pinus rigida, Quercus lyrata, Phaseolus coccineus, Larus ridibundus, Sargocentron spiniferum, Thunnus thynnus, Vulpes lagopus, Bos gaurus frontalis, Acer opalus, Acer palmatum, Quercus ilex, Pinus mugo, Grus antigone, Pinus uncinata, Prunus mume, Oncorhynchus tschawytscha, Gazella subgutturosa, Vulpes zerda, Pinus coulteri, Gossypium barbadense, Acer pseudoplatanus, Oncorhynchus nerka, Sus barbatus, Fagopyrum esculentum* subsp. *Ancestrale, Cynara cardunculus, Phaseolus aureus, Populus nigra, Gossypium schwendimanii, Solanum chacoense, Quercus rubra, Cucumis sativus, Equus burchelli, Oncorhynchus kisutch, Pinus radiata, Phoca vitulina richardsi, Grus nigricollis, Abies grandis, Oncorhynchus masou, Spinacia oleracea, Solanum chilense, Addax nasomaculatus, Ipomoea batatas, Equus grevyi, Abies sachalinensis, Pinus pinea, Hipposideros commersoni, Crocus nudiflorus, Citrus maxima, Acipenser transmontanus, Gossypium gossypioides, Viverra zibetha, Quercus cerris, Anser indicus, Pinus balfouriana, Silene otites, Oncorhynchus* sp., *Viverra megaspila, Bos mutus grunniens, Pinus elliottii, Equus hemionus kulan, Capra ibex ibex, Allium sativum, Raphanus sativus, Pinus echinata, Prunus serotina, Sargocentron diadema, Silene gallica, Brassica oleracea, Daucus carota, Oncorhynchus mykiss, Brassica oleracea* var. *alboglabra, Gossypium hirsutum, Abies alba, Citrus reticulata, Cichorium intybus, Bos sauveli, Lama glama, Zea mays, Acorus gramineus, Vulpes macrotis, Ovis ammon darwini, Raphicerus sharpei, Pinus contorta, Bos indicus, Capra sibirica, Pinus ponderosa, Prunus dulcis, Solanum sogarandinum, Ipomoea aquatica, Lagenorhynchus albirostris, Ovis canadensis, Prunus avium, Gazella dama, Thunnus alalunga, Silene pratensis, Pinus cembra, Crocus sativus, Citrullus lanatus, Gazella rufifrons, Brassica tournefortii, Capra falconeri, Bubalus mindorensis, Pinus palustris, Prunus laurocerasus, Grus vipio, Ipomoea purpurea, Pinus leiophylla, Lagenorhynchus obscurus, Raphicerus campestris, Brassica rapa* subsp. *Pekinensis, Acmella radicans, Ipomoea triloba, Pinus patula, Cucumis melo, Pinus virginiana, Solanum lycopersicum, Pinus densflora, Pinus engelmannii, Quercus robur, Ipomoea setosa, Pleurotus djamor, Hipposideros diadema, Ovis aries, Sargocentron microstoma, Brassica oleracea* var. *italica, Capra cylindricornis, Populus kitakamiensis, Allium textile, Vicia faba, Fagopyrum esculentum, Bison priscus, Quercus suber, Lagophylla ramosissima, Acrantophis madagascariensis, Acipenser baerii, Capsicum annuum, Triticum aestivum, Xenopus laevis, Phoca sibirica, Acipenser naccarii, Actinidia chinensis, Ovis dalli, Solanum tuberosum, Bubalus carabanensis, Citrus jambhiri, Bison bonasus, Equus asinus, Bubalus depressicornis, Pleurotus eryngii, Solanum demissum, Ovis vignei, Zea mays* subsp. *Parviglumis, Lathyrus tingitanus, Welwitschia mirabilis, Grus rubicunda, Ipomoea coccinea, Allium cepa, Gazella soemmerringii, Brassica rapa, Lama vicugna, Solanum peruvianum, Xenopus borealis, Capra caucasica, Thunnus albacares, Equus zebra, Gallus gallus, Solanum bulbocastanum, Hipposideros terasensis, Lagenorhynchus acutus, Hippopotamus amphibius, Pinus koraiensis, Acer monspessulanum, Populus deltoides, Populus trichocarpa, Acipenser guldenstadti, Pinus thunbergii, Brassica oleracea* var. *capitata, Abyssocottus korotneffi, Gazella cuvieri, Abies homolepis, Abies holophylla, Gazella gazella, Pinus parviflora, Brassica oleracea* var. *acephala, Cucurbita pepo, Pinus armandii, Abies mariesii, Thunnus thynnus orientalis, Citrus unshiu, Solanum cheesmanii, Lagenorhynchus obliquidens, Acer platanoides, Citrus limon, Acrantophis dumerili, Solanum commersonii, Gossypium arboreum, Prunus persica, Pleurotus ostreatus, Abies firma, Gazella leptoceros, Salmo salar, Homarus americanus, Abies magnifica, Bos javanicus, Phoca largha, Sus cebifrons, Solanum melongena, Phoca vitulina, Pinus sylvestris, Zamia floridana, Vulpes corsac, Allium porrum, Phoca caspica, Vulpes chama, Taxus chinensis, Brassica oleracea*var. *botrytis, Anser anser anser, Phaseolus lunatus, Brassica campestris, Acer saccharum, Pinus pumila, Solanum pennellii, Pinus edulis, Ipomoea cordatotriloba, Populus alba, Oncorhynchus clarki, Quercus petraea, Sus verrucosus, Equus caballus przewalskii, Populus euphratica, Xenopus tropicalis, Taxus brevifolia, Lama guanicoe, Pinus banksiana, Solanum nigrum, Sus celebensis, Brassica juncea, Lagenorhynchus cruciger, Populus tremuloides, Pinus pungens, Bubalus quarlesi, Quercus gamelliflora, Ovis orientalis musimon, Bubalus bubalis, Pinus luchuensis, Sus philippensis, Phaseolus vulgaris, Salmo trutta, Acipenser persicus, Solanum brevidens, Pinus resinosa, Hippotragus niger, Capra nubiana, Asparagus scaber, Ipomoea platensis, Sus scrofa, Capra aegagrus, Lathyrus sativus, Sargocentron tiere, Hippoglossus hippoglossus, Acorus americanus, Equus caballus, Bos taurus, Barbarea vulgaris, Lama guanicoe pacos, Pinus pinaster, Octopus vulgaris, Solanum crispum, Hippotragus equinus, Equus burchellii antiquorum, Crossarchus alexandri, Ipomoea alba, Triticum monococcum, Populus jackii, Lagenorhynchus australis, Gazella dorcas, Quercus coccifera, Anser caerulescens, Acorus calamus, Pinus roxburghii, Pinus tabuliformis, Zamia fischeri, Grus carunculatus, Acomys cahirinus, Cucumis melo* var. *reticulatus, Gallus lafayettei, Pisum sativum, Pinus attenuata, Pinus clausa, Gazella saudiya, Capra ibex, Ipomoea trifida, Zea luxurians, Pinus krempfii, Acomys wilsoni, Petroselinum crispum, Quercus palustris, Triticum timopheevi, Meleagris gallopavo, Brassica oleracea, Brassica oleracea, Beta vulgaris, Solanum lycopersicum, Phaseolus vulgaris, Xiphias gladius, Morone saxatilis, Micropterus salmoides, Placopecten magellanicus, Sprattus sprattus, Clupea harengus, Engraulis encrasicolus, Cucurbita maxima, Agaricus bisporus, Musa acuminata×balbisiana, Malus domestica, Cicer arietinum, Anas platyrhynchos, Vaccinium macrocarpum, Rubus idaeus× strigosus, Vaccinium angustifolium, Fragaria ananassa, Rubus fruticosus, Cucumis melo, Ananas comosus, Cucurbita pepo, Cucurbita moschata, Sus scrofa domesticus, Ocimum basilicum, Rosmarinus officinalis, Foeniculum vul-* gare, *Rheum rhabarbarum, Carica papaya, Mangifera indica, Actinidia deliciosa, Prunus armeniaca, Prunus avium, Cocos nucifera, Olea europaea, Pyrus communis, Ficus carica, Passiflora edulis, Oryza sativa* subsp. *Japonica, Oryza sativa* subsp. *Indica, Coturnix coturnix, Saccharomyces cerevisiae.*

In some embodiments the nutritive protein comprises or consists of a derivative or mutein of a protein or fragment of a protein that naturally occurs in an edible species. Such a nutrive protein may be referred to as an "engineered nutritive protein." In such embodiments the natural protein or fragment thereof is a "reference" protein or polypeptide and the engineered nutritive protein or a first polypeptide sequence thereof comprises at least one sequence modification relative to the amino acid sequence of the reference protein or polypeptide. For example, in some embodiments the engineered nutritive protein or first polypeptide sequence thereof is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one reference nutritive protein amino acid sequence. Typically the ratio of at least one of branch chain amino acid residues to total amino acid residues, essential amino acid residues to total amino acid residues, and leucine residues to total amino acid residues, present in the engineered nutritive protein or a first polypeptide sequence thereof is greater than the corresponding ratio of at least one of branch chain amino acid residues to total amino acid residues, essential amino acid residues to total amino acid residues, and leucine residues to total amino acid residues present in the reference nutritive protein or polypeptide sequence.

In some embodiments the nutritive protein is an abundant protein in food or a derivative or mutein thereof, or is a fragment of an abundant protein in food or a derivative or mutein thereof. An abundant protein is a protein that is present in a higher concentration in a food relative to other proteins present in the food. The food can be a known component of the diet of only a small group of a type of mammal in a limited geographic location, or a dietary staple throughout much of the world. In some embodiments the abundant protein in food is selected from chicken egg proteins such as ovalbumin, ovotransferrin, and ovomucuoid; meat proteins such as myosin, actin, tropomyosin, collagen, and troponin; cereal proteins such as casein, alpha1 casein, alpha2 casein, beta casein, kappa casein, beta-lactoglobulin, alpha-lactalbumin, glycinin, beta-conglycinin, glutelin, prolamine, gliadin, glutenin, albumin, globulin; chicken muscle proteins such as albumin, enolase, creatine kinase, phosphoglycerate mutase, triosephosphate isomerase, apolipoprotein, ovotransferrin, phosphoglucomutase, phosphoglycerate kinase, glycerol-3-phosphate dehydrogenase, glyceraldehyde 3-phosphate dehydrogenase, hemoglobin, cofilin, glycogen phosphorylase, fructose-1,6-bisphosphatase, actin, myosin, tropomyosin a-chain, casein kinase, glycogen phosphorylase, fructose-1, 6-bisphosphatase, aldolase, tubulin, vimentin, endoplasmin, lactate dehydrogenase, destrin, transthyretin, fructose bisphosphate aldolase, carbonic anhydrase, aldehyde dehydrogenase, annexin, adenosyl homocysteinase; pork muscle proteins such as actin, myosin, enolase, titin, cofilin, phosphoglycerate kinase, enolase, pyruvate dehydrogenase, glycogen phosphorylase, triosephosphate isomerase, myokinase; and fish proteins such as parvalbumin, pyruvate dehydrogenase, desmin, and triosephosphate isomerase.

Three natural sources of protein generally regarded as good sources of high quality amino acids are whey protein, egg protein, and soy protein. Each source comprises multiple proteins. Table 1A presents the weight proportional representation of each amino acid in the protein source (g AA/g protein) expressed as a percentage.

TABLE 1A

| Amino Acid | Whey | Egg | Soy |
| --- | --- | --- | --- |
| Isoleucine | 6.5% | 5.5% | 5.0% |
| Leucine | 11.0% | 8.6% | 8.0% |
| Lysine | 9.1% | 7.2% | 6.3% |
| Methionine | 2.1% | 3.1% | 1.3% |
| Phenylalanine | 3.4% | 5.3% | 1.2% |
| Threonine | 7.0% | 4.8% | 3.7% |
| Tryptophan | 1.7% | 1.2% | 1.3% |
| Valine | 6.2% | 6.1% | 4.9% |
| Histidine | 2.0% | 2.4% | 2.7% |
| Other | 51.7% | 49.5% | 60.4% |

Based on the percentages presented in Table 1, the weight proportion of each protein source that is essential amino acids, branched chain amino acids (L, I, and V), and leucine (L) is presented in Table 1B.

TABLE 1B

| Protein Source | Essential Amino Acids | Branch Chain Amino Acids | Leucine |
| --- | --- | --- | --- |
| Whey | 49.0% | 23.7% | 11.0% |
| Egg | 50.5% | 20.1% | 8.6% |
| Soy | 39.6% | 17.9% | 8.0% |

The sources relied on to determine the amino acid content of Whey are: Belitz H D., Grosch W., and Schieberle P. Food Chemistry (4th Ed). Springer-Verlag, Berlin Heidelberg 2009; http://www.gnc.com/product/index.jsp?productId=2986027; http://www.nutrabio.com/Products/whey_protein_concentrate.htm; and http://nutrabio.com/Products/whey_protein_isolate.htm. The amino acid content values from those sources were averaged to give the numbers presented in Tables 1 and 2. The source for soy protein is Egg, National Nutrient Database for Standard Reference, Release 24 (http://ndb.nal.usda.gov/ndb/foods/list). The source for soy protein is Self Nutrition Data (http://nutritiondata.self.com/facts/legumes-and-legume-products/4389/2).

As used herein, "whey protein" or "whey" means a protein mixture comprising an amino acid composition according to Tables 1A and 1B. As used herein, whey protein comprises 49% essential amino acids, 24% branch chain amino acids, and 11% leucine, by weight.

As used herein, "egg protein" or "egg" means a protein mixture comprising an amino acid composition according to Tables 1A and 1B. As used herein, egg protein comprises 51% essential amino acids, 20% branch chain amino acids, and 9% leucine, by weight.

As used herein, "soy protein" or "soy" means a protein mixture comprising an amino acid composition according to Tables 1A and 1B. As used herein, soy protein comprises 40% essential amino acids, 18% branch chain amino acids, and 8% leucine, by weight.

While these proteins are relatively high in essential amino acids compared to the other proteins that make up traditional human diets, the proteins do not necessarily provide a proportion of total essential and conditionally essential amino acids for optimal nutrition and/or digestibility. Another feature of these protein sources is that the ratio of each essential amino acid and conditionally essential amino acid in the source to the optimum ratio for each amino acid is generally lower than it could be. In general, a protein source that provides each amino acid in a ratio that is close to the optimum for that amino acid is a more efficient protein source. Put another way, if a first protein source provides each amino acid at a ratio closer to its optimum ratio than a second protein source does, a diet comprising a significant contribution to total protein from the first protein source may provide a sufficient amount of each amino acid at a lower amount of total protein consumed than would be required in a diet comprising a significant contribution to total protein from the second protein source.

As an example of the above point, the World Health Organization (WHO) recommends 58 g/day of a protein diet with a protein digestibility corrected amino acid score (PDCAAS) of 1 for a person weighing 70 kg. This requirement can be further broken down into the minimum amino acid requirements (in grams) shown in Table 2A.

TABLE 2A

| H | I | L | K | SAA | AAA | T | W | V |
|---|---|---|---|-----|-----|---|---|---|
| 0.87 | 1.74 | 3.42 | 2.61 | 1.28 | 2.20 | 1.33 | 0.35 | 2.26 |

By comparison, 58 g of a protein with a PDCAAS of 2 translates into the minimum amino acid amounts (in grams) shown in Table 2B

TABLE 2B

| H | I | L | K | SAA | AAA | T | W | V |
|---|---|---|---|-----|-----|---|---|---|
| 1.74 | 3.49 | 6.86 | 5.23 | 2.56 | 4.42 | 2.67 | 0.70 | 4.53 |

As such, 29 g of a protein with a PDCAAS of 2 provides the same amount of nutrition obtained in 58 g of a protein with a PDCAAS of 1 (i.e. comparable amounts or more of each amino acid).

As another example of the above point, consider a low PDCAAS diet consisting only of wheat protein, which provides the follow amounts of each amino acid (in mg/g of total protein) and is notably deficient in L (Table 2C).

TABLE 2C

| PDCAAS | H | I | L | K | SAA | AAA | T | W | V |
|--------|---|---|---|---|-----|-----|---|---|---|
| 0.15 | 23.0 | 40.9 | 85.3 | 6.9 | 22.7 | 107.4 | 20.3 | 7.8 | 42.9 |

In order to fortify 1 g of this diet and bring the PDCAAS score up to a value of 1, (i.e. a diet containing the WHO recommended amino acid intake values), approximately 0.7 g of whey protein, 1.8 g of egg protein, or 4 g of soy protein would be required. By comparison, only 0.3 g of a protein with a nutritionally balanced ratio of essential and conditionally essential amino acids (PDCAAS 3.61) is required to fortify 1 g of wheat protein. In some instances herein the portion of amino acid(s) of a particular type within a polypeptide, protein or a composition is quantified based on the weight ratio of the type of amino acid(s) to the total weight of amino acids present in the polypeptide, protein or composition in question. This value is calculated by dividing the weight of the particular amino acid(s) in the polypeptide, protein or a composition by the weight of all amino acids present in the polypeptide, protein or a composition.

The minimum daily requirements for essential amino acids in adult humans (>18 years of age) proposed by the WHO, in milligrams of each amino acid per gram of total protein, are as presented in Table 3A:

TABLE 3A

|  | H | I | L | K | SAA | AAA | T | W | V |
|---|---|---|---|---|-----|-----|---|---|---|
| >18 | 15 | 30 | 59 | 45 | 22 | 38 | 23 | 6.0 | 39 |

Note that in the WHO analysis Y (a conditionally-essential amino acid) is grouped with F and reported as a total value for aromatic amino acids (AAA), and C is grouped with M and reported as a total value for sulphur containing amino acids (SAA). The WHO adopts this convention because in certain groups under certain conditions C and Y can be essential.

Converting milligrams to grams yields numbers presented in Table 3B that correspond to the minimal fraction of essential amino acids required in a healthy, adult diet (i.e. grams of amino acid/grams of total protein):

TABLE 3B

|  | H | I | L | K | SAA | AAA | T | W | V |
|---|---|---|---|---|-----|-----|---|---|---|
| >18 | 0.015 | 0.03 | 0.059 | 0.045 | 0.022 | 0.038 | 0.023 | 0.006 | 0.039 |

Adding up these fractions yields a total of 0.277, meaning that the minimal required amount of EAAs and CEAAs in the adult diet need only account for 27.7% of the total protein intake. If a protein is intended to provide only the essential/conditionally essential amino acid component of a diet it may comprise a higher proportion of EAA/CEAAs, up to 100%. The relative percentages of each EAA and CEAA in such a protein are obtained by multiplying the fractions shown in Table 3B by (100/27.7≈3.61). The fraction of each EAA and CEAA in such a protein is then as presented in Table 3C:

TABLE 3C

|  | H | I | L | K | SAA | AAA | T | W | V |
|---|---|---|---|---|-----|-----|---|---|---|
| >18 | 0.054 | 0.108 | 0.213 | 0.162 | 0.079 | 0.137 | 0.083 | 0.022 | 0.141 |

The minimum fractions of each EAA that make up a healthy adult diet provide a metric against which dietary protein sources can be measured. For example, the fractions can be used to measure how well a dietary protein source meets the nutritional protein needs of humans, by targeting nutritionally balanced amino acid percentages. Based on the WHO recommendations, the nutritionally balanced amino acid percentages for the essential amino acids, along with the associated protein digestibility corrected amino acid score (PDCAAS), assuming 100% digestion, are shown below in Table 4.

TABLE 4

Nutritionally Ballanced EAA/CEAA Target Percentages for an Adult (>18 yo)

| % EAA + % CEAA | PDCAAS | H | I | L | K | SAA | AAA | T | W | V |
|---|---|---|---|---|---|---|---|---|---|---|
| 100 | 3.6 | 5.4 | 10.8 | 21.3 | 16.2 | 7.9 | 13.7 | 8.3 | 2.2 | 14.1 |
| 90 | 3.2 | 4.9 | 9.7 | 19.2 | 14.6 | 7.1 | 12.3 | 7.5 | 1.9 | 12.7 |
| 80 | 2.9 | 4.3 | 8.7 | 17.0 | 13.0 | 6.4 | 11.0 | 6.6 | 1.7 | 11.3 |
| 70 | 2.5 | 3.8 | 7.6 | 14.9 | 11.4 | 5.6 | 9.6 | 5.8 | 1.5 | 9.9 |
| 60 | 2.2 | 3.2 | 6.5 | 12.8 | 9.7 | 4.8 | 8.2 | 5.0 | 1.3 | 8.4 |
| 50 | 1.8 | 2.7 | 5.4 | 10.6 | 8.1 | 4.0 | 6.9 | 4.2 | 1.1 | 7.0 |
| 40 | 1.4 | 2.2 | 4.3 | 8.5 | 6.5 | 3.2 | 5.5 | 3.3 | 0.9 | 5.6 |
| 30 | 1.1 | 1.6 | 3.2 | 6.4 | 4.9 | 2.4 | 4.1 | 2.5 | 0.6 | 4.2 |
| 27.7 | 1 | 1.5 | 3 | 5.9 | 4.5 | 2.2 | 3.8 | 2.3 | 0.6 | 3.9 |
| 20 | 0.7 | 1.1 | 2.2 | 4.3 | 3.2 | 1.6 | 2.7 | 1.7 | 0.4 | 2.8 |
| 10 | 0.4 | 0.5 | 1.1 | 2.1 | 1.6 | 0.8 | 1.4 | 0.8 | 0.2 | 1.4 |

SAA—Sulfur containing amino acids (Methionine, Cysteine)
AAA—Aromatic amino acids (Phenylalanine, Tyrosine)

The PDCAAS score is a WHO suggested scoring metric for assessing nutritional protein values for humans. To compute the PCDAAS for a given protein, one simply computes the relative fraction of EAAs and CEAAs present and divides by the numbers shown in Table 3B. (Note: For the purpose of this disclosure, the calculation of a PDCAAS score assumes that the dietary protein under evaluation is completely digested and bioavailable). For each EAA and CEAA, this gives the fraction of the requirement provided by the protein. The PCDAAS value of a protein or polypeptide sequence is simply the smallest of these values for the protein or polypeptide sequence. It indicates the worst case fraction of EAA or CEAA requirements provided by the protein/polypeptide. Note that the above analysis shows why the highest possible PCDAAS is 3.61. The only way to increase the PCDAAS further would be to increase the total EAA+CEAA concentration >100%, which of course is not possible.

Recently the WHO has renamed and slightly revised the PDCAAS standard, giving the revised standard the name "Digestible Indispensable Amino Acid Score (DIAAS)". (See "Dietary Protein Quality Evaluation in Human Nutrition: Report of an FAO Expert Consultation," FAO Food and Nutrution Paper 92 (2013).) The new standard revises somewhat the digestibility assumptions used to calculate a DIAAS score versus a PDCAAS score. Assuming the protein under consideration is 100% digestible and bioavailable, as is done herein, the two standards are largely interchangeable. For the avoidance of doubt, the disclosure uses the terms "PDCAAS" and "PDCAAS score" as defined herein to define properties of proteins and polypeptides. The PDCAAS values assigned to the nutritive proteins and polypeptides of this disclosure assume that the dietary protein under evaluation is completely digestable and bioavailable. As demonstrated in Example 13, for example, the nutritive proteins and polypeptides of this disclosure display useful levels of digestibility and in several embodiments are more easily digested than protein standards such as whey. Example 13 also presents data demonstrating that in some embodiments recombinant nutritive proteins and polypeptides of this disclosure have a higher digestability than native forms of the proteins of polypeptide such as the forms that are present in whole foods and/or processed foods.

Digestibility of a protein source is an important prerequsite to the nutritional value of the protein. If a protein is not well digested its bioavailability will be lower and as a result the actual nutritional value of the protein may be lower than its amino acid composition would otherwise suggest. Moreover, a protein that is more rapidly digested than a second protein will deliver nutrition faster than the second protein and with less input energy. Rapid digestibility is also thought to be correlated with reduced allergenicity. (See Goodman R. E., Vieths S. Sampson H. A. Hill D., Ebisawa M., Taylor S., van Ree R. Nat. Biotech. (2008) 26: 73:81; Ofori-Anti A. O., Ariyarathna H., Chen L., Lee H. L., Pramod S, N., Goodman R. E. Reg. Toxicol. Phamacol. (2008) 52: 94-103.) A protein that digests more rapidly than a second protein is around for shorter amount of time and thus less likely to interact with gut localized IgE and elicit an immune response before it is digested and/or absorbed. Whey is a good example of this. It is a known allergen and does not digest quickly, even though it is bioavailable over many hours. In some embodiments the nutritive proteins of this disclosure are more rapidly digested than protein standards such as whey, soy, and/or egg. In some embodiments that feature of the proteins of this disclosure contributes to their usefulness as protein sources for ingestion In some embodiments the nutritive proteins of this disclosure have a lower allergenicity than protein standards such as whey, soy, and/or egg.

In general, the nutritive proteins provided by this disclosure comprise at least 50% by weight EAAs. In some embodiments the nutritive proteins comprise at least 55% by weight EAAs, at least 60% by weight EAAs, at least 65% by weight EAAs, at least 70% by weight EAAs, at least by weight 75% EAAs, at least 80% by weight EAAs, at least 85% by weight EAAs, at least 90% by weight EAAs, or at least 95% by weight EAAs, at least 96% by weight EAAs, at least 97% by weight EAAs, at least 98% by weight EAAs, at least 99% by weight EAAs, or 100% EAAs. In some embodiments the nutritive proteins of this disclosure comprise from 50 to 100% by weight EAAs, from 60 to 100% by weight EAAs, from 70 to 100% by weight EAAs, from 80 to 90% by weight EAAs, from 60 to 90% by weight EAAs, from 60 to 80% by weight EAAs, from 70 to 90% by weight EAAs, from 60 to 70% by weight EAAs, from 70 to 80% by weight EAAs, from 80 to 90% by weight EAAs, and from 90 to 100% by weight EAAs. In some embodiments the nutritive proteins comprise from 90% to 100% EAAs and CEAAs (that is, the combined fraction of essential amino acids and conditionally essential amino acids in the nutritive proteins is from 90% to 100%. In some embodiments the nutritive proteins comprise 100% EAAs and CEAAs.

In some embodiments the PDCAAS of the nutritive protein is at least about 1.4, at least about 1.5, at least about 1.6, at least about 1.7, at least about 1.8, at least about 1.9, at least about 2.0, at least about 2.1, at least about 2.2, at least about 2.3, at least about 2.4, at least about 2.5, at least about 2.6, at least about 2.7, at least about 2.8, at least about 2.9, at least about 3.0, at least about 3.1, at least about 3.2, at least about 3.3, at least about 3.4, at least about 3.5, or about 3.6. In some embodiments of the nutritive proteins, the PDCAAS of the nutritive protein is from about 1.4 to about 1.6, from about 1.4 to about 1.8, from about 1.4 to about 2.0, from about 1.4 to about 2.2, from about 1.4 to about 2.4, from about 1.4 to about 2.6, from about 1.4 to about 2.8, from about 1.4 to about 3.0, from about 1.4 to about 3.2, from about 1.4 to about 3.4, or from about 1.4 to about 3.6.

In some embodiments the nutritive protein comprises at least 50% by weight EAAs and has a PDCAAS of at least about 1.4. In some embodiments the nutritive protein has a PDCAAS of from about 1.4 to about 1.8.

In some embodiments of the nutritive protein at least 60% by weight of the amino acids are essential amino acids. In some embodiments the nutritive protein has a PDCAAS of from about 1.4 to about 2.2.

In some embodiments of the nutritive protein at least 70% by weight of the amino acids are essential amino acids. In some embodiments the nutritive protein has a PDCAAS of from about 1.4 to about 2.5.

In some embodiments of the nutritive protein at least 80% by weight of the amino acids are essential amino acids. In some embodiments the nutritive protein has a PDCAAS of from about 1.4 to about 2.9.

In some embodiments of the nutritive protein at least 90% by weight of the amino acids are essential amino acids. In some embodiments the nutritive protein has a PDCAAS of from about 1.4 to about 3.2.

In some embodiments the nutritive protein further comprises at least one of every non-essential amino acid. In some embodiments the nutritive protein further comprises a nutritionally balanced ratio of non-essential amino acids.

In some embodiments the nutritive protein comprises 100% essential amino acids or 100% essential and conditionally-essential amino acids. In some embodiments the nutritive protein has a PDCAAS of from about 1.4 to about 3.6.

In some embodiments the nutritive protein comprises or consists of a naturally-occurring protein or fragment thereof.

In some embodiments the nutritive protein comprises an altered amino acid sequence compared to the amino acid sequence of a naturally-occurring reference protein and a weight ratio of essential amino acids to total amino acids present in the nutritive protein that is higher than the weight ratio of essential amino acids to total amino acids present in the naturally-occurring reference protein. In some embodiments the nutritive protein comprises at least one essential amino acid residue substitution of a non-essential amino acid residue in the naturally-occurring reference protein.

In some embodiments the nutritive protein is selected from: A. an amino acid sequence comprising the amino acid sequence of a protein listed in at least one of Tables 9-11; B. an amino acid sequence comprising a modified derivative of the amino acid sequence of a protein listed in at least one of Tables 9-11; C. an amino acid sequence comprising a mutein of the amino acid sequence of a protein listed in at least one of Tables 9-11; D. an amino acid sequence comprising a fragment of at least 20 amino acids of the amino acid sequence of a protein listed in at least one of Tables 9-11; E. an amino acid sequence comprising a modified derivative of a fragment of at least 20 amino acids of the amino acid sequence of a protein listed in at least one of Tables 9-11; F. an amino acid sequence comprising a mutein of a fragment of at least 20 amino acids of the amino acid sequence of a protein listed in at least one of Tables 9-11; G. an amino acid sequence comprising the amino acid sequence of a fragment listed in at least one of Tables 6-8; H. an amino acid sequence comprising a modified derivative of the amino acid sequence of a fragment listed in at least one of Tables 6-8; and I. an amino acid sequence comprising a mutein of the amino acid sequence of a fragment listed in at least one of Tables 6-8.

In some embodiments the nutritive protein is selected from: A. an amino acid sequence consisting of the amino acid sequence of a protein listed in at least one of Tables 9-11; B. an amino acid sequence consisting of a modified derivative of the amino acid sequence of a protein listed in at least one of Tables 9-11; C. an amino acid sequence consisting of a mutein of the amino acid sequence of a protein listed in at least one of Tables 9-11; D. an amino acid sequence consisting of a fragment of at least 20 amino acids of the amino acid sequence of a protein listed in at least one of Tables 9-11; E. an amino acid sequence consisting of a modified derivative of a fragment of at least 20 amino acids of the amino acid sequence of a protein listed in at least one of Tables 9-11; F. an amino acid sequence consisting of a mutein of a fragment of at least 20 amino acids of the amino acid sequence of a protein listed in at least one of Tables 9-11; G. an amino acid sequence consisting of the amino acid sequence of a fragment listed in at least one of Tables 6-8; H. an amino acid sequence consisting of a modified derivative of the amino acid sequence of a fragment listed in at least one of Tables 6-8; and I. an amino acid sequence consisting of a mutein of the amino acid sequence of a fragment listed in at least one of Tables 6-8.

In some embodiments the nutritive protein is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one amino acid sequence selected from: A. the amino acid sequence of a protein listed in at least one of Tables 9-11; B. a fragment of at least 20 amino acids of the amino acid sequence of a protein listed in at least one of Tables 9-11; and C. the amino acid sequence of a fragment listed in at least one of Tables 6-8.

In some embodiments the nutritive protein comprises a first polypeptide sequence that comprises at least 20 amino acids. In some embodiments the first polypeptide sequence comprises at least 30 amino acids, at least 40 amino acids, at least 50 amino acids, at least 60 amino acids, at least 70 amino acids, at least 80 amino acids, at least 90 amino acids, at least 100 amino acids, at least 110 amino acids, at least 120 amino acids, at least 130 amino acids, at least 140 amino acids, at least 150 amino acids, at least 160 amino acids, at least 170 amino acids, at least 180 amino acids, at least 190 amino acids, at least 200 amino acids, at least 300 amino acids, at least 400 amino acids, at least 500 amino acids, at least 600 amino acids, at least 700 amino acids, at least 800 amino acids, at least 900 amino acids, or at least 1,000 amino acids. In some embodiments the first polypeptide sequence comprises from 20 to 50 amino acids, from 20 to 75 amino acids, from 20 to 100 amino acids, from 30 to 100 amino acids, from 40 to 100 amino acids, from 50 to 100 amino acids, from 50 to 200 amino acids, from 100 to 200 amino acids, from 200 to 300 amino acids, from 300 to 400 amino acids, or from 400 to 500 amino acids.

In some embodiments the first polypeptide sequence comprises at least 50% by weight EAAs. In some embodiments the first polypeptide sequence comprises at least 55% by weight EAAs, at least 60% by weight EAAs, at least 65% by weight EAAs, at least 70% by weight EAAs, at least by weight 75% EAAs, at least 80% by weight EAAs, at least 85% by weight EAAs, at least 90% by weight EAAs, or at least 95% by weight EAAs, at least 96% by weight EAAs, at least 97% by weight EAAs, at least 98% by weight EAAs, at least 99% by weight EAAs, or 100% EAAs. In some embodiments the first polypeptide sequence comprises from 50 to 100% by weight EAAs, from 60 to 100% by weight EAAs, from 70 to 100% by weight EAAs, from 80 to 90% by weight EAAs, from 60 to 90% by weight EAAs, from 60 to 80% by weight EAAs, from 70 to 90% by weight EAAs, from 60 to 70% by weight EAAs, from 70 to 80% by weight EAAs, from 80 to 90% by weight EAAs, and from 90 to 100% by weight EAAs. In some embodiments the first polypeptide sequence comprises from 90% to 100% EAAs and CEAAs. In some embodiments the first polypeptide sequence comprises 100% EAAs and CEAAs.

In some embodiments the PDCAAS of the first polypeptide sequence is at least about 1.4, at least about 1.5, at least about 1.6, at least about 1.7, at least about 1.8, at least about 1.9, at least about 2.0, at least about 2.1, at least about 2.2, at least about 2.3, at least about 2.4, at least about 2.5, at least about 2.6, at least about 2.7, at least about 2.8, at least about 2.9, at least about 3.0, at least about 3.1, at least about 3.2, at least about 3.3, at least about 3.4, at least about 3.5, or about 3.6. In some embodiments of the nutritive proteins, the PDCAAS of the first polypeptide sequence is from about 1.4 to about 1.6, from about 1.4 to about 1.8, from about 1.4 to about 2.0, from about 1.4 to about 2.2, from about 1.4 to about 2.4, from about 1.4 to about 2.6, from about 1.4 to about 2.8, from about 1.4 to about 3.0, from about 1.4 to about 3.2, from about 1.4 to about 3.4, or from about 1.4 to about 3.6.

In some embodiments the first polypeptide sequence has a PDCAAS of at least about 1.4. In some embodiments the first polypeptide sequence has a PDCAAS of from about 1.4 to about 1.8.

In some embodiments of the nutritive protein at least 60% by weight of the amino acids of the first polypeptide sequence are essential amino acids. In some embodiments the first polypeptide sequence has a PDCAAS of from about 1.4 to about 2.2.

In some embodiments of the nutritive protein at least 70% by weight of the amino acids of the first polypeptide sequence are essential amino acids. In some embodiments the first polypeptide sequence has a PDCAAS of from about 1.4 to about 2.5.

In some embodiments of the nutritive protein at least 80% by weight of the amino acids of the first polypeptide sequence are essential amino acids. In some embodiments the first polypeptide sequence has a PDCAAS of from about 1.4 to about 2.9.

In some embodiments of the nutritive protein at least 90% by weight of the amino acids of the first polypeptide sequence are essential amino acids. In some embodiments the first polypeptide sequence has a PDCAAS of from about 1.4 to about 3.2.

In some embodiments of the nutritive protein, the first polypeptide sequence further comprises at least one of every non-essential amino acid. In some embodiments of the nutritive protein, the first polypeptide sequence further comprises a nutritionally balanced ratio of non-essential amino acids.

In some embodiments of the nutritive protein, the first polypeptide sequence comprises 100% essential and conditionally essential amino acids. In some embodiments the first polypeptide sequence has a PDCAAS of from about 1.4 to about 3.6.

In some embodiments of the nutritive protein, the first polypeptide sequence comprises or consists of a naturally-occurring protein or fragment thereof.

In some embodiments of the nutritive protein, the first polypeptide sequence comprises an altered amino acid sequence compared to the amino acid sequence of a naturally-occurring reference protein and a weight ratio of essential amino acids to total amino acids present in the nutritive protein that is higher than the weight ratio of essential amino acids to total amino acids present in the naturally-occurring reference protein. In some embodiments the first polypeptide sequence comprises at least one essential amino acid residue substitution of a non-essential amino acid residue in the naturally-occurring reference protein.

In some embodiments of the nutritive protein, the first polypeptide sequence is selected from: A. an amino acid sequence comprising the amino acid sequence of a protein listed in at least one of Tables 9-11; B. an amino acid sequence comprising a modified derivative of the amino acid sequence of a protein listed in at least one of Tables 9-11; C. an amino acid sequence comprising a mutein of the amino acid sequence of a protein listed in at least one of Tables 9-11; D. an amino acid sequence comprising a fragment of at least 20 amino acids of the amino acid sequence of a protein listed in at least one of Tables 9-11; E. an amino acid sequence comprising a modified derivative of a fragment of at least 20 amino acids of the amino acid sequence of a protein listed in at least one of Tables 9-11; F. an amino acid sequence comprising a mutein of a fragment of at least 20 amino acids of the amino acid sequence of a protein listed in at least one of Tables 9-11; G. an amino acid sequence comprising the amino acid sequence of a fragment listed in at least one of Tables 6-8; H. an amino acid sequence comprising a modified derivative of the amino acid sequence of a fragment listed in at least one of Tables 6-8; and I. an amino acid sequence comprising a mutein of the amino acid sequence of a fragment listed in at least one of Tables 6-8.

In some embodiments of the nutritive protein, the first polypeptide sequence is selected from: A. an amino acid sequence consisting of the amino acid sequence of a protein listed in at least one of Tables 9-11; B. an amino acid sequence consisting of a modified derivative of the amino acid sequence of a protein listed in at least one of Tables 9-11; C. an amino acid sequence consisting of a mutein of the amino acid sequence of a protein listed in at least one of Tables 9-11; D. an amino acid sequence consisting of a fragment of at least 20 amino acids of the amino acid sequence of a protein listed in at least one of Tables 9-11; E. an amino acid sequence consisting of a modified derivative of a fragment of at least 20 amino acids of the amino acid sequence of a protein listed in at least one of Tables 9-11; F. an amino acid sequence consisting of a mutein of a fragment of at least 20 amino acids of the amino acid sequence of a protein listed in at least one of Tables 9-11; G. an amino acid sequence consisting of the amino acid sequence of a fragment listed in at least one of Tables 6-8; H. an amino acid sequence consisting of a modified derivative of the amino acid sequence of a fragment listed in at least one of Tables 6-8; and I. an amino acid sequence consisting of a mutein of the amino acid sequence of a fragment listed in at least one of Tables 6-8.

In some embodiments of the nutritive protein, the first polypeptide sequence is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one amino acid sequence selected from: A. the amino acid sequence of a protein listed in at least one of Tables 9-11; B. a fragment of at least 20 amino acids of the amino acid sequence of a protein listed in at least one of Tables 9-11; and C. the amino acid sequence of a fragment listed in at least one of Tables 6-8.

In some embodiments the nutritive protein consists of the first polypeptide sequence.

In some embodiments the nutritive protein further comprises a second polypeptide sequence. In some embodiments the second polypeptide sequence comprises of from 3 to 10, 5 to 20, 10 to 30, 20 to 50, 25 to 75, 50 to 100 or 100 to 200 amino acids. In some embodiments the second polypeptide sequence is selected from a tag for affinity purification, a protein domain linker, and a protease recognition site. In some embodiments the tag for affinity purification is a polyhistidine-tag. In some embodiments the protein domain linker comprises at least one copy of the sequence GGSG. In some embodiments the protease is selected from pepsin, trypsin, and chymotrypsin.

In some embodiments the nutritive protein consists of the first polypeptide sequence and the second polypeptide sequence.

In some embodiments the nutritive protein further comprises a third polypeptide sequence. In some embodiments third polypeptide sequence comprises at least 20 amino acids, at least 30 amino acids, at least 40 amino acids, at least 50 amino acids, at least 60 amino acids, at least 70 amino acids, at least 80 amino acids, at least 90 amino acids, at least 100 amino acids, at least 110 amino acids, at least 120 amino acids, at least 130 amino acids, at least 140 amino acids, at least 150 amino acids, at least 160 amino acids, at least 170 amino acids, at least 180 amino acids, at least 190 amino acids, at least 200 amino acids, at least 300 amino acids, at least 400 amino acids, at least 500 amino acids, at least 600 amino acids, at least 700 amino acids, at least 800 amino acids, at least 900 amino acids, or at least 1,000 amino acids. In some embodiments the third polypeptide sequence comprises from 20 to 50 amino acids, from 20 to 75 amino acids, from 20 to 100 amino acids, from 30 to 100 amino acids, from 40 to 100 amino acids, from 50 to 100 amino acids, from 50 to 200 amino acids, from 100 to 200 amino acids, from 200 to 300 amino acids, from 300 to 400 amino acids, or from 400 to 500 amino acids In some embodiments the third polypeptide sequence comprises at least 50% by weight EAAs. In some embodiments the third polypeptide sequence comprises at least 55% by weight EAAs, at least 60% by weight EAAs, at least 65% by weight EAAs, at least 70% by weight EAAs, at least by weight 75% EAAs, at least 80% by weight EAAs, at least 85% by weight EAAs, at least 90% by weight EAAs, or at least 95% by weight EAAs, at least 96% by weight EAAs, at least 97% by weight EAAs, at least 98% by weight EAAs, at least 99% by weight EAAs, or 100% EAAs. In some embodiments the third polypeptide sequence comprises from 50 to 100% by weight EAAs, from 60 to 100% by weight EAAs, from 70 to 100% by weight EAAs, from 80 to 90% by weight EAAs, from 60 to 90% by weight EAAs, from 60 to 80% by weight EAAs, from 70 to 90% by weight EAAs, from 60 to 70% by weight EAAs, from 70 to 80% by weight EAAs, from 80 to 90% by weight EAAs, and from 90 to 100% by weight EAAs. In some embodiments the third polypeptide sequence comprises from 90% to 100% EAAs and CEAAs. In some embodiments the third polypeptide sequence comprises 100% EAAs and CEAAs.

In some embodiments the PDCAAS of the third polypeptide sequence is at least about 1.4, at least about 1.5, at least about 1.6, at least about 1.7, at least about 1.8, at least about 1.9, at least about 2.0, at least about 2.1, at least about 2.2, at least about 2.3, at least about 2.4, at least about 2.5, at least about 2.6, at least about 2.7, at least about 2.8, at least about 2.9, at least about 3.0, at least about 3.1, at least about 3.2, at least about 3.3, at least about 3.4, at least about 3.5, or about 3.6. In some embodiments of the nutritive proteins, the PDCAAS of the third polypeptide sequence is from about 1.4 to about 1.6, from about 1.4 to about 1.8, from about 1.4 to about 2.0, from about 1.4 to about 2.2, from about 1.4 to about 2.4, from about 1.4 to about 2.6, from about 1.4 to about 2.8, from about 1.4 to about 3.0, from about 1.4 to about 3.2, from about 1.4 to about 3.4, or from about 1.4 to about 3.6.

In some embodiments the third polypeptide sequence comprises at least 20 amino acids and at least 50% by weight of the amino acids of the third polypeptide sequence are essential amino acids. In some embodiments the third polypeptide sequence has a protein digestibility corrected amino acid score (PDCAAS) of at least about 1.4. In some embodiments the third polypeptide sequence has a PDCAAS of from about 1.4 to about 1.8.

In some embodiments of the nutritive protein, the third polypeptide sequence comprises at least 60% by weight essential amino acids. In some embodiments the third polypeptide sequence has a PDCAAS of from about 1.4 to about 2.2.

In some embodiments of the nutritive protein, the third polypeptide sequence comprises at least 70% by weight essential amino acids. In some embodiments the third polypeptide sequence has a PDCAAS of from about 1.4 to about 2.5.

In some embodiments of the nutritive protein, the third polypeptide sequence comprises at least 80% by weight essential amino acids. In some embodiments the third polypeptide sequence has a PDCAAS of from about 1.4 to about 2.9.

In some embodiments of the nutritive protein, the third polypeptide sequence comprises at least 90% by weight essential amino acids. In some embodiments the third polypeptide sequence has a PDCAAS of from about 1.4 to about 3.2.

In some embodiments of the nutritive protein, the third polypeptide sequence comprises a weight ratio of each non-essential amino acid to the total number of amino acids that is equivalent to the weight ratio of each non-essential amino acid to the total number of amino acids in a benchmark protein. In some embodiments the benchmark protein is selected from whey protein, egg protein and soy protein.

In some embodiments of the nutritive protein, the third polypeptide sequence comprises at least 100% essential or conditionally essential amino acids. In some embodiments the third polypeptide sequence has a PDCAAS of from about 1.4 to about 3.6.

In some embodiments of the nutritive proteins the third polypeptide sequence comprises a naturally-occurring protein or fragment thereof.

In some embodiments of the nutritive protein, the third polypeptide sequence comprises an altered amino acid sequence compared to the amino acid sequence of a naturally-occurring reference protein and a weight ratio of essential amino acids to total amino acids present in the nutritive protein that is higher than the weight ratio of essential amino acids to total amino acids present in the naturally-occurring reference protein. In some embodiments the third polypeptide sequence comprises at least one essential amino acid residue substitution of a non-essential amino acid residue in the naturally-occurring reference protein.

In some embodiments of the nutritive protein, the third polypeptide sequence is selected from: A. an amino acid sequence comprising the amino acid sequence of a protein listed in at least one of Tables 9-11; B. an amino acid sequence comprising a modified derivative of the amino acid sequence of a protein listed in at least one of Tables 9-11; C. an amino acid sequence comprising a mutein of the amino acid sequence of a protein listed in at least one of Tables 9-11; D. an amino acid sequence comprising a fragment of at least 20 amino acids of the amino acid sequence of a protein listed in at least one of Tables 9-11; E. an amino acid sequence comprising a modified derivative of a fragment of at least 20 amino acids of the amino acid sequence of a protein listed in at least one of Tables 9-11; F. an amino acid sequence comprising a mutein of a fragment of at least 20 amino acids of the amino acid sequence of a protein listed in at least one of Tables 9-11; G. an amino acid sequence comprising the amino acid sequence of a fragment listed in at least one of Tables 6-8; H. an amino acid sequence comprising a modified derivative of the amino acid sequence of a fragment listed in at least one of Tables 6-8; and I. an amino acid sequence comprising a mutein of the amino acid sequence of a fragment listed in at least one of Tables 6-8.

In some embodiments of the nutritive protein, the third polypeptide sequence is selected from: A. an amino acid sequence consisting of the amino acid sequence of a protein listed in at least one of Tables 9-11; B. an amino acid sequence consisting of a modified derivative of the amino acid sequence of a protein listed in at least one of Tables 9-11; C. an amino acid sequence consisting of a mutein of the amino acid sequence of a protein listed in at least one of Tables 9-11; D. an amino acid sequence consisting of a fragment of at least 20 amino acids of the amino acid sequence of a protein listed in at least one of Tables 9-11; E. an amino acid sequence consisting of a modified derivative of a fragment of at least 20 amino acids of the amino acid sequence of a protein listed in at least one of Tables 9-11; F. an amino acid sequence consisting of a mutein of a fragment of at least 20 amino acids of the amino acid sequence of a protein listed in at least one of Tables 9-11; G. an amino acid sequence consisting of the amino acid sequence of a fragment listed in at least one of Tables 6-8; H. an amino acid sequence consisting of a modified derivative of the amino acid sequence of a fragment listed in at least one of Tables 6-8; and I. an amino acid sequence consisting of a mutein of the amino acid sequence of a fragment listed in at least one of Tables 6-8.

In some embodiments of the nutritive protein, the third polypeptide sequence is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one amino acid sequence selected from: A. the amino acid sequence of a protein listed in at least one of Tables 9-11; B. a fragment of at least 20 amino acids of the amino acid sequence of a protein listed in at least one of Tables 9-11; and C. the amino acid sequence of a fragment listed in at least one of Tables 6-8.

In some embodiments the nutritive protein comprises first and third polypeptide sequences that are the same.

In some embodiments the nutritive protein comprises first and third polypeptide sequences that are different.

In some embodiments the nutritive protein comprises first and third polypeptide sequences and further comprise a second polypeptide sequence comprising at least 3 amino acids, wherein the second polypeptide sequence is flanked by the first and third polypeptide sequences.

In some embodiments the EAA content of the nutritive protein is less than 100%. In some embodiments the NEAAs present in such a nutritive protein may have any distribution of NEAAs. In some embodiments the nutritive protein does not comprise at least one NEAA.

In some embodiments the NEAAs present in such a nutritive protein have a distribution of NEAAs that provides a balanced mix of NEAAs. In some embodiments the NEAAs present in the nutritive protein are present in proportions similar to the proportions of NEAAs present in a benchmark dietary protein source. For example, if a nutritive protein comprises about 60% EAAs and about 40% NEAAs, the NEAA content of the nutritive protein may be selected or designed to be similar to the proportions of each NEAA present in a benchmark protein.

The NEAA distribution for Whey is shown in Table 5A. These values come from a basic tabulation of the average relative AA fractions for the proteins found in Bovine Whey. The fractions used for this analysis are: Beta-lactoglogulin (UniProtID: P02754), alpha-lactoglobulin (P00711), and serum albumin (P02769), assuming relative protein percentages of 65%, 25%, and 10%, respectively. See H.-D. Belitz, W. Grosch, and P. Schieberle. Food Chemistry 3rd revised Edition. Springer-Verlag, 2004. Note that Belitz et al. also point to a small contribution from immuniglobulins which are varied in amino acid composition. For the purposes of this analysis that fraction was ignored. Similarly, Belitz et al. point to a large proteose-peptone (digested proteins) component. Because that component is assumed to be primarily fragments of the three proteins listed here it was ignored.

TABLE 5A

Whey NEAA Target Percentages

| % NEAA | A | R | N | D | Q | E | G | P | S |
|---|---|---|---|---|---|---|---|---|---|
| 50 | 9.49 | 1.87 | 3.82 | 7.27 | 5.74 | 8.87 | 3.68 | 4.12 | 5.14 |
| 40 | 7.59 | 1.50 | 3.05 | 5.82 | 4.60 | 7.09 | 2.94 | 3.29 | 4.11 |
| 30 | 5.69 | 1.12 | 2.29 | 4.36 | 3.45 | 5.32 | 2.21 | 2.47 | 3.09 |
| 20 | 3.79 | 0.75 | 1.53 | 2.91 | 2.30 | 3.55 | 1.47 | 1.65 | 2.06 |
| 10 | 1.90 | 0.37 | 0.76 | 1.45 | 1.15 | 1.77 | 0.74 | 0.82 | 1.03 |

The NEAA distribution for Soy is shown in Table 5B. These values come from a basic tabulation of the average relative AA fractions for the proteins found in *Glycine Max*: Glycinin subunits 1-5 (UniProtID: P04776, P04405, P11828, P02858, and P04347, respectively), Beta-conglycinin A (P13916), Beta-conglycinin AP (P11827), and Beta-conglycinin B (P25974), assuming a glycinin/conglycinin breakdown of 64% to 34% and equal contributions from each glycinin/Beta-conglycinin subunits with relative protein percentages of 0.128, 0.128, 0.128, 0.128, 0.128, 0.12, 0.12, and 0.12, respectively. See Adachi M, Kanamori J., Masuda T., Yagasaki K., Kitamura K., Mikami B., and S. Utsumi. Crystal structure of soybean 11S globulin: Glycinin A3B4 homohexamer. Proc. Natl. Acad. Sci. USA. (2003) 100: 7395-7400; and J. H. Kuipers. Aggregation of peptides in soy protein isolate hydrolysates; The individual contributions of glycinin- and β-conglycinin-derived peptides. Ph.D. Thesis. Wageningen University, The Netherlands, 2007.

TABLE 5B

Soy NEAA Target Percentages

| % NEAA | A | R | N | D | Q | E | G | P | S |
|---|---|---|---|---|---|---|---|---|---|
| 50 | 2.77 | 7.61 | 6.07 | 3.72 | 8.65 | 9.17 | 2.67 | 4.44 | 4.89 |
| 40 | 2.22 | 6.09 | 4.86 | 2.97 | 6.92 | 7.34 | 2.14 | 3.55 | 3.92 |
| 30 | 1.66 | 4.57 | 3.64 | 2.23 | 5.19 | 5.50 | 1.60 | 2.66 | 2.94 |
| 20 | 1.11 | 3.04 | 2.43 | 1.49 | 3.46 | 3.67 | 1.07 | 1.78 | 1.96 |
| 10 | 0.55 | 1.52 | 1.21 | 0.74 | 1.73 | 1.83 | 0.53 | 0.89 | 0.98 |

The NEAA distribution for Egg is shown in Table 5C. These values come from a basic tabulation of the average relative AA fractions for the proteins found in *Gallus gallus*: Ovalbumin (UniProtID: P01012), ovotransferrin (P02789), and ovomucoid (P68390), assuming relative protein percentages of 0.72, 0.14, and 0.14, respectively. See H.-D. Belitz, W. Grosch, and P. Schieberle. Food Chemistry $3^{rd}$ revised Edition. Springer-Verlag, 2004.

TABLE 5C

Egg NEAA Target Percentages

| % NEAA | A | R | N | D | Q | E | G | P | S |
|---|---|---|---|---|---|---|---|---|---|
| 50 | 5.62 | 5.75 | 5.28 | 4.81 | 4.08 | 10.40 | 3.14 | 3.51 | 7.41 |
| 40 | 4.50 | 4.60 | 4.23 | 3.85 | 3.26 | 8.32 | 2.51 | 2.81 | 5.93 |
| 30 | 3.37 | 3.45 | 3.17 | 2.89 | 2.45 | 6.24 | 1.88 | 2.11 | 4.45 |
| 20 | 2.25 | 2.30 | 2.11 | 1.92 | 1.63 | 4.16 | 1.25 | 1.40 | 2.96 |
| 10 | 1.12 | 1.15 | 1.06 | 0.96 | 0.82 | 2.08 | 0.63 | 0.70 | 1.48 |

In some embodiments the nutritive protein comprises each NEAA at a weight ratio that is at least 50% of the weight ratio of that NEAA present in a benchmark dietary protein source. In some embodiments the nutritive protein comprises each NEAA at a weight ratio that is at least 55% of the weight ratio of that NEAA present in a benchmark dietary protein source. In some embodiments the nutritive protein comprises each NEAA at a weight ratio that is at least weight 60% of the ratio of that NEAA present in a benchmark dietary protein source. In some embodiments the nutritive protein comprises each NEAA at a weight ratio that is at least 70% of the weight ratio of that NEAA present in a benchmark dietary protein source. In some embodiments the nutritive protein comprises each NEAA at a weight ratio that is at least 80% of the weight ratio of that NEAA present in a benchmark dietary protein source. In some embodiments the nutritive protein comprises each NEAA at a weight ratio that is at least 90% of the weight ratio of that NEAA present in a benchmark dietary protein source. In some embodiments the nutritive protein comprises each NEAA at a weight ratio that is at least 95% of the weight ratio of that NEAA present in a benchmark dietary protein source. In some embodiments the nutritive protein comprises each NEAA at a weight ratio that is at least 99% of the weight ratio of that NEAA present in a benchmark dietary protein source. In some embodiments the benchmark dietary protein source is whey protein. In some embodiments the benchmark dietary protein source is egg protein. In some embodiments the benchmark dietary protein source is soy protein. In some embodiments the benchmark dietary protein source is a blended average of at least two of from 25% to 75% whey protein, from 25% to 75% egg protein, and from 25% to 75% soy protein.

The Euclidean distance of a given amino acid distribution (p) to a target distribution (t) is calculated using the following formula $$\text{Distance} = \sqrt{\Sigma_{i \in AA}(p_i - t_i)^2},$$

where AA={H, I, L, K, SAA, AAA, T, W, V, A, R, N, D, Q, E, G, P, and S}, $p_i$ is the fraction of amino acid i in the given protein distribution, and t is the fraction of amino acid i in the target distribution. This metric corresponds to the square root of the sum of the squared error for each amino acid (EAAs, CEAAs, and NEAAs), and measures the percent distance between a given and target amino acid distribution.

In some embodiments herein the Euclidian distance of the amino acid distribution profile of a nutritive protein or fragment thereof is determined relative to a target amino acid distribution profile. In some embodiments the target amino acid distribution profile comprises a target distribution for EAAs. In some embodiments the target amino acid distribution profile comprises a target distribution for NEAAs. In some embodiments the target amino acid distribution profile comprises a target distribution for CEAAs. In some embodiments the target amino acid distribution profile comprises a target distribution for at least two of EAAs, CEAAs, and NEAAs. In some embodiments the target amino acid distribution profile comprises a target distribution for EAAs, CEAAs, and NEAAs. In some embodiments the target amino acid distribution profile of EAAs and CEAAs is a PDCAAS score. In some embodiments the target amino acid distribution profile of NEAAs is the NEAA amino acid distribution profile of NEAAs present in a benchmark dietary protein source.

In some embodiments the target amino acid distribution profile of EAAs and CEAAs is a PDCAAS score of at least about 1.4, at least about 1.5, at least about 1.6, at least about 1.7, at least about 1.8, at least about 1.9, at least about 2.0, at least about 2.1, at least about 2.2, at least about 2.3, at least about 2.4, at least about 2.5, at least about 2.6, at least about 2.7, at least about 2.8, at least about 2.9, at least about 3.0, at least about 3.1, at least about 3.2, at least about 3.3, at least about 3.4, at least about 3.5, or about 3.6. In some embodiments the target amino acid distribution profile of EAAs and CEAAs is a PDCAAS score of at least about 1.4 to about 1.6, from about 1.4 to about 1.8, from about 1.4 to about 2.0, from about 1.4 to about 2.2, from about 1.4 to about 2.4, from about 1.4 to about 2.6, from about 1.4 to about 2.8, from about 1.4 to about 3.0, from about 1.4 to about 3.2, from about 1.4 to about 3.4, or from about 1.4 to about 3.6. In some embodiments the target amino acid distribution profile comprises at least 50% by weight EAAs. In some embodiments the target amino acid distribution profile comprises at least 55% by weight EAAs, at least 60% by weight EAAs, at least 65% by weight EAAs, at least 70% by weight EAAs, at least by weight 75% EAAs, at least 80% by weight EAAs, at least 85% by weight EAAs, at least 90% by weight EAAs, or at least 95% by weight EAAs, at least 96% by weight EAAs, at least 97% by weight EAAs, at least 98% by weight EAAs, at least 99% by weight EAAs, or 100% EAAs. In some embodiments the target amino acid distribution profile comprises from 50 to 100% by weight EAAs, from 60 to 100% by weight EAAs, from 70 to 100% by weight EAAs, from 80 to 90% by weight EAAs, from 60 to 90% by weight EAAs, from 60 to 80% by weight EAAs, from 70 to 90% by weight EAAs, from 60 to 70% by weight EAAs, from 70 to 80% by weight EAAs, from 80 to 90% by weight EAAs, and from 90 to 100% by weight EAAs. In some embodiments the target amino acid distribution profile comprises from 90% to 100% EAAs and CEAAs (that is, the combined fraction of essential amino acids and conditionally essential amino acids in the nutritive proteins is from 90% to 100%.

In some embodiments herein a fragment of a naturally-occurring nutritive protein is produced and optionally isolated. In some embodiments the fragment comprises at least 50 amino acids. In some embodiments the fragment consists of at least 50 amino acids.

In some embodiments an isolated recombinant nutritive protein is provided. In some embodiments the nutritive protein comprises a first polypeptide sequence, and the first polypeptide sequence comprises a fragment of at least 50 amino acids of a naturally-occurring nutritive protein. In some embodiments the nutritive protein is isolated. In some embodiments the nutritive protein is recombinant. In some embodiments the nutritive protein comprises a first polypeptide sequence comprising a fragment of at least 50 amino acids of a naturally-occurring nutritive protein. In some embodiments the nutritive proteins are isolated recombinant nutritive proteins. In some embodiments the isolated recombinant nutritive proteins disclosed herein are provided in a non-isolated and/or non-recombinant form.

In some embodiments the nutritive protein is a nutritive protein other than at least one nutritive protein selected from egg proteins such as ovalbumin, ovotransferrin, and ovomucuoid; meat proteins such as myosin, actin, tropomyosin, collagen, and troponin; milk proteins such as whey and casein; cereal proteins such as casein, alpha1 casein, alpha2 casein, beta casein, kappa casein, beta-lactoglobulin, alpha-lactalbumin, glycinin, beta-conglycinin, glutelin, prolamine, gliadin, glutenin, albumin, globulin; chicken muscle proteins such as albumin, enolase, creatine kinase, phosphoglycerate mutase, triosephosphate isomerase, apolipoprotein, ovotransferrin, phosphoglucomutase, phosphoglycerate kinase, glycerol-3-phosphate dehydrogenase, glyceraldehyde 3-phosphate dehydrogenase, hemoglobin, cofilin, glycogen phosphorylase, fructose-1,6-bisphosphatase, actin, myosin, tropomyosin a-chain, casein kinase, glycogen phosphorylase, fructose-1,6-bisphosphatase, aldolase, tubulin, vimentin, endoplasmin, lactate dehydrogenase, destrin, transthyretin, fructose bisphosphate aldolase, carbonic anhydrase, aldehyde dehydrogenase, annexin, adenosyl homocysteinase; pork muscle proteins such as actin, myosin, enolase, titin, cofilin, phosphoglycerate kinase, enolase, pyruvate dehydrogenase, glycogen phosphorylase, triosephosphate isomerase, myokinase; and fish proteins such as parvalbumin, pyruvate dehydrogenase, desmin, and triosephosphate isomerase.

Phenylketonuria (PKU) is an autosomal recessive metabolic genetic disorder characterized by a mutation in the gene for the hepatic enzyme phenylalanine hydroxylase (PAH), rendering it nonfunctional. This enzyme is necessary to metabolize phenylalanine to tyrosine. When PAH activity is reduced, phenylalanine accumulates and is converted into phenylpyruvate (also known as phenylketone), which is detected in the urine. Untreated children are normal at birth, but fail to attain early developmental milestones, develop microcephaly, and demonstrate progressive impairment of cerebral function. Hyperactivity, EEG abnormalities and seizures, and severe learning disabilities are major clinical problems later in life. A characteristic odor of skin, hair, sweat and urine (due to phenylacetate accumulation); and a tendency to hypopigmentation and eczema are also observed. All PKU patients must adhere to a special diet low in Phe. Accordingly, nutritive proteins comprising a low number or no Phe residues are desirable for PKU patients. Such proteins can be obtained by selecting nutritive proteins provided herein that have few or no Phe residues. Accordingly, in some embodiments the nutritive protein comprises a ratio of Phe residues to total amino acid residues equal to or lower than 5%, 4%, 3%, 2%, or 1%. In some embodiments the nutritive protein comprises 10 or fewer Phe residues, 9 or fewer Phe residues, 8 or fewer Phe residues, 7 or fewer Phe residues, 6 or fewer Phe residues, 5 or fewer Phe residues, 4 or fewer Phe residues, 3 or fewer Phe residues, 2 or fewer Phe residues, 1 Phe residue, or no Phe residues. In some embodiments, the nutritive protein comprises no Phe residues.

Arginine is a conditionally nonessential amino acid, meaning most of the time it can be manufactured by the human body, and does not need to be obtained directly through the diet. Individuals who have poor nutrition, the elderly, or people with certain physical conditions (e.g., sepsis) may not produce sufficient amounts of arginine and therefore need to increase their intake of foods containing arginine. Arginine is believed to have beneficial health properties, including reducing healing time of injuries (particularly bone), and decreasing blood pressure, particularly high blood pressure during high risk pregnancies (pre-eclampsia). In addition, studies have shown that dietary supplementation with L-arginine is beneficial for enhancing the reproductive performance of pigs with naturally occurring in-trauterine growth retardation, enhancing protein deposition and postnatal growth of milk-fed piglets, normalizing plasma glucose levels in streptozotocin-induced diabetic rats, reducing fat mass in obese Zucker diabetic fatty (ZDF) rats, and improving vascular function in diabetic rats. In order to combine these benefits with at least one utility of the nutritive proteins disclosed herein, in some embodiments of the nutritive proteins disclosed herein the nutritive protein comprises a ration of Arginine residues to total amino acid residues in the nutritive protein of equal to or greater than 3%, equal to or greater than 4%, equal to or greater than 5%, equal to or greater than 6%, equal to or greater than 7%, equal to or greater than 8%, equal to or greater than 9%, equal to or greater than 10%, equal to or greater than 11%, or equal to or greater than 12%.

Digestibility is a parameter relevant to the nutritive benefits and utility of nutritive proteins. Information relating to the relative completeness of digestion can serve as a predictor of peptide bioavailability (Daniel, H., 2003. Molecular and Integrative Physiology of Intestinal Peptide Transport. *Annual Review of Physiology*, Volume 66, pp. 361-384). In some embodiments nutritive proteins disclosed herein are screened to assess their digestibility. Digestibility of nutritive proteins can be assessed by any suitable method known in the art. In some embodiments digestability is assessed by a physiologically relevant in vitro digestion reaction that includes one or both phases of protein digestion, simulated gastric digestion and simulated intestinal digestion (see, e.g., Moreno, et al., 2005. Stability of the major allergen Brazil nut 2S albumin (Ber e 1) to physiologically relevant in vitro gastrointestinal digestion. *FEBS Journal*, pp. 341-352; Martos, G., Contreras, P., Molina, E. & Lopez-Fandino, R., 2010. Egg White Ovalbumin Digestion Mimicking Physiological Conditions. *Journal of Agricultural and food chemistry*, pp. 5640-5648; Moreno, F. J., Mackie, A. R. & Clare Mills, E. N., 2005. Phospholipid interactions protect the milk allergen a-Lactalbumin from proteolysis during in vitro digestion. *Journal of agricultural and food chemistry*, pp. 9810-9816). Briefly, test proteins are sequentially exposed to a simulated gastric fluid (SGF) for 120 minutes (the length of time it takes 90% of a liquid meal to pass from the stomach to the small intestine; see Kong, F. & Singh, R. P., 2008. Disintegration of Solid Foods in Human Stomach. *Journal of Food Science*, pp. 67-80) and then transferred to a simulated duodenal fluid (SDF) to digest for an additional 120 minutes. Samples at different stages of the digestion (e.g., 2, 5, 15, 30, 60 and 120 min) are analyzed by electrophoresis (e.g., chip electrophoresis or SDS-PAGE) to monitor the size and amount of intact protein as well as any large digestion fragments (e.g., larger than 4 kDa). The disappearance of protein over time indicates the rate at which the protein is digested in the assay. By monitoring the amount of intact protein observed over time, the half-life ($\tau_{1/2}$) of digestion is calculated for SGF and, if intact protein is detected after treatment with SGF, the $\tau_{1/2}$ of digestion is calculated for SIF. This assay can be used to assess comparative digestibility (i.e., against a benchmark protein such as whey) or to assess absolute digestibility. In some embodiments the digestibility of the nutritive protein is higher (i.e., the SGF $\tau_{1/2}$ and/or SIF $\tau_{1/2}$ is shorter) than whey protein. In some embodiments the nutritive protein has a SGF $\tau_{1/2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the nutritive protein has a SIF $\tau_{1/2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the nutritive protein is not detectable in one or both of the SGF and SIF assays by 2 minutes, 5 minutes, 15 minutes, 30 minutes, 60 minutes, or 120 minutes. In some embodiments the nutritive protein is digested at a constant rate and/or at a controlled rate in one or both of SGF and SIF. In such embodiments the rate of digestion of the nutritive protein may not be optimized for the highest possible rate of digestion. In such embodiments the rate of absorption of the protein following ingestion by a mammal may be slower and the total time period over which absorption occurs following ingestion may be longer than for nutritive proteins of similar amino acid composition that are digested at a faster initial rate in one or both of SGF and SIF. In some embodiments the nutritive protein is completely or substantially completely digested in SGF. In some embodiments the nutritive protein is substantially not digested or not digested by SGF; in most such embodiments the protein is digested in SIF. Assessing protein digestibility can also provide insight into a protein's potential allergenicity, as proteins or large fragments of proteins that are resistant to digestive proteases can have a higher risk of causing an allergenic reaction (Goodman, R. E. et al., 2008. Allergenicity assessment of genetically modified crops—what makes sense? *Nature Biotechnology*, pp. 73-81). To detect and identify peptides too small for chip electrophoresis analysis, liquid chromatography and mass spectrometry can be used. In SGF samples, peptides can be directly detected and identified by LC/MS. SIF protein digestions may require purification to remove bile acids before detection and identification by LC/MS.

In some embodiments digestibility of a nutritive protein is assessed by identification and quantification of digestive protease recognition sites in the protein amino acid sequence. In some embodiments the nutritive protein comprises at least one protease recognition site selected from a pepsin recognition site, a trypsin recognition site, and a chymotrypsin recognition site.

As used herein, a "pepsin recognition site" is any site in a polypeptide sequence that is experimentally shown to be cleaved by pepsin. In some embodiments it is a peptide bond after (i.e., downstream of) an amino acid residue selected from Phe, Trp, Tyr, Leu, Ala, Glu, and Gln, provided that the following residue is not an amino acid residue selected from Ala, Gly, and Val.

As used herein, a "trypsin recognition site" is any site in a polypeptide sequence that is experimentally shown to be cleaved by trypsin. In some embodiments it is a peptide bond after an amino acid residue selected from Lys or Arg, provided that the following residue is not a proline.

As used herein, a "chymotrypsin recognition site" is any site in a polypeptide sequence that is experimentally shown to be cleaved by chymotrypsin. In some embodiments it is a peptide bond after an amino acid residue selected from Phe, Trp, Tyr, and Leu.

Disulfide bonded cysteine residues in a protein tend to reduce the rate of digestion of the protein compared to what it would be in the absence of the disulfide bond. For example, it has been shown that the rate of digestion of the protein b-lactoglobulin is increased when its disulfide bridges are cleaved (I. M. Reddy, N. K. D. Kella, and J. E. Kinsella. "Structural and Conformational Basis of the Resistance of B-Lactoglobulin to Peptic and Chymotryptic Digestion". J. Agric. Food Chem. 1988, 36, 737-741). Accordingly, digestibility of a nutritive protein with fewer disulfide bonds tends to be higher than for a comparable nutritive protein with a greater number of disulfide bonds. In some embodiments the nutritive proteins disclosed herein are screened to identify the number of cysteine residues present in each and in particular to allow selection of a nutritive protein comprising a relatively low number of cysteine residues. For example, naturally occurring nutritive proteins or fragments may be identified that comprise a no Cys residues or that comprise a relatively low number of Cys residues, such as 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments one or more Cys residues in a naturally occurring nutritive protein or fragment thereof is removed by deletion and/or by substitution with another amino acid. In some embodiments 1 Cys residue is deleted or replaced, 1 or more Cys residues are deleted or replaced, 2 or more Cys residues are deleted or replaced, 3 or more Cys residues are deleted or replaced, 4 or more Cys residues are deleted or replaced, 5 or more Cys residues are deleted or replaced, 6 or more Cys residues are deleted or replaced, 7 or more Cys residues are deleted or replaced, 8 or more Cys residues are deleted or replaced, 9 or more Cys residues are deleted or replaced, or or more Cys residues are deleted or replaced. In some embodiments the nutritive protein of this disclosure comprises a ratio of Cys residues to total amino acid residues equal to or lower than 5%, 4%, 3%, 2%, or 1%. In some embodiments the nutritive protein comprises 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments, the nutritive protein comprises 1 or fewer Cys residues. In some embodiments, the nutritive protein comprises no Cys residues.

Alternatively or in addition, disulfide bonds that are or may be present in a nutritive protein may be removed. Disulfides can be removed using chemical methods by reducing the disulfide to two thiol groups with reducing agents such as beta-mercaptoethanol, dithiothreitol (DTT), or tris(2-carboxyethyl)phosphine (TCEP). The thiols can then be covalently modified or "capped" with reagents such as iodoacetamide, N-ethylmaleimide, or sodium sulfite (see, e.g., Crankshaw, M. W. and Grant, G. A. 2001. Modification of Cysteine. Current Protocols in Protein Science. 15.1.1-15.1.18).

Eukaryotic proteins are often glycosylated, and the carbohydrate chains that are attached to proteins serve various functions. N-linked and O-linked glycosylation are the two most common forms of glycosylation occurring in proteins. N-linked glycosylation is the attachment of a sugar molecule to a nitrogen atom in an amino acid residue in a protein. N-linked glycosylation occurs at Asparagine and Arginine residues. O-linked glycosylation is the attachment of a sugar molecule to an oxygen atom in an amino acid residue in a protein. O-linked glycosylation occurs at Threonine and Serine residues.

Glycosylated proteins are often more soluble than their un-glycosylated forms. In terms of protein drugs, proper glycosylation usually confers high activity, proper antigen binding, better stability in the blood, etc. However, glycosylation necessarily means that a protein "carries with it" sugar moieties. Such sugar moieties may reduce the usefulness of the nutritive proteins of this disclosure including recombinant nutritive proteins. For example, as demonstrated in the examples, a comparison of digestion of glycosylated and non-glycosylated forms of the same proteins shows that the non-glycosylated forms are digested more quickly than the glycosylated forms. For these reasons, in some embodiments the nutrive proteins according to the disclosure comprise low or no glycosylation. For example, in some embodiments the nutritive proteins comprise a ratio of non-glycosilated to total amino acid residues of at least 80%, at least 85%, at least 90%, at least 95%, at least 96%, at least 97%, at least 98%, or at least 99%. In some embodiments the nutritive proteins to not comprise any glycosylation.

In some embodiments, the nutritive protein according to the disclosure is de-glycosylated after it is produced or after it is isolated. Nutritive proteins of low or no glycosylation may be made by any method known in the art. For example, enzymatic and/or chemical methods may be used (Biochem. J. (2003) 376, p339-350). Enzymes are produced commercially at research scales for the removal of N-linked and O-linked oligosaccharides. Chemical methods include use of trifluoromethanesulfonic acid to selectively break N-linked and O-linked peptide-saccharide bonds. This method often results in a more complete deglycosylation than does the use of enzymatic methods.

In other embodiments, the nutritive protein according to the disclosure is produced with low or no glycosylation by chemical synthesis or by a host organism. Most bacteria and other prokaryotes have very limited capabilities to glycosylate proteins, especially heterologous proteins. Accordingly, in some embodiments of this disclosure a nutritive protein is made recombinantly in a microorganism such that the level of glycosylation of the recombinant protein is low or no glycosylation. In some embodiments the level of glycosylation of the recombinant nutritive protein is lower than the level of glycosylation of the protein as it occurs in the organism from which it is derived.

In some embodiments a nutritive protein or polypeptide according to the disclosure comprises a ratio of amino acids selected from Asn, Arg, Ser, and Thr to total amino acids of 20% or less, 19% or less, 18% or less, 17% or less, 16% or less, 15% or less, 14% or less, 13% or less, 12% or less, 11% or less, 10% or less, 9% or less, 8% or less, 7% or less, 6% or less, 5% or less, 4% or less, 3% or less, 2% or less, 1% or less. In some embodiments, a nutritive protein or polypeptide according to the disclosure comprises no amino acids selected from Asn, Arg, Ser, and Thr. In some embodiments a nutritive protein or polypeptide according to the disclosure comprises fewer than 20, fewer than 19, fewer than 18, fewer than 17, fewer than 16, fewer than 15, fewer than 14, fewer than 13, fewer than 12, fewer than 11, fewer than 10, fewer than 9, fewer than 8, fewer than 7, fewer than 6, fewer than 5, fewer than 4, fewer than 3, fewer than 2, fewer than 1, or no amino acids selected from Asn, Arg, Ser, and Thr.

In some embodiments of the nutritive proteins disclosed herein the nutritive protein is soluble. Solubility can be measured by any method known in the art. In some embodiments solubility is examined by centrifuge concentration followed by protein concentration assays. Samples of nutritive proteins in 20 mM HEPES pH 7.5 are tested for protein concentration according to protocols using two methods, Coomassie Plus (Bradford) Protein Assay (Thermo Scientific) and Bicinchoninic Acid (BCA) Protein Assay (Sigma-Aldrich). Based on these measurements 10 mg of protein is added to an Amicon Ultra 3 kDa centrifugal filter (Millipore). Samples are concentrated by centrifugation at 10,000×g for 30 minutes. The final, now concentrated, samples are examined for precipitated protein and then tested for protein concentration as above using two methods, Bradford and BCA.

In some embodiments the nutritive proteins have a final solubility limit of at least 5 g/L, 10 g/L, 20 g/L, 30 g/L, 40 g/L, 50 g/L, or 100 g/L at physiological pH. In some embodiments the nutritive proteins are greater than 50%, greater than 60%, greater than 70%, greater than 80%, greater than 90%, greater than 95%, greater than 96%, greater than 97%, greater than 98%, greater than 99%, or greater than 99.5% soluble with no precipitated protein observed at a concentration of greater than 5 g/L, or 10 g/L, or 20 g/L, or 30 g/L, or 40 g/L, or 50 g/L, or 100 g/L at physiological pH. In some embodiments, the solubility of the nutritive protein is higher than those typically reported in studies examining the solubility limits of whey (12.5 g/L; Pelegrine et al., Lebensm.-Wiss. U.-Technol. 38 (2005) 77-80) and soy (10 g/L; Lee et al., JAOCS 80(1) (2003) 85-90).

As used herein, a "stable" protein is one that resists changes (e.g., unfolding, oxidation, aggregation, hydrolysis, etc.) that alter the biophysical (e.g., solubility), biological (e.g., digestibility), or compositional (e.g. proportion of Leucine amino acids) traits of the protein of interest.

Protein stability can be measured using various assays known in the art and nutritive proteins disclosed herein and having stability above a threshold can be selected. In some embodiments a protein is selected that displays thermal stability that is comparable to or better than that of whey protein. Thermal stability is a property that can help predict the shelf life of a nutritive protein. In some embodiments of the assay stability of nutritive protein samples is determined by monitoring aggregation formation using size exclusion chromatography (SEC) after exposure to extreme temperatures. Aqueous samples of the protein to be tested are placed in a heating block at 90° C. and samples are taken after 0, 1, 5, 10, 30 and 60 min for SEC analysis. Protein is detected by monitoring absorbance at 214 nm, and aggregates are characterized as peaks eluting faster than the protein of interest. No overall change in peak area indicates no precipitation of protein during the heat treatment. Whey protein has been shown to rapidly form ~80% aggregates when exposed to 90° C. in such an assay.

In some embodiments the thermal stability of a nutritive protein is determined by heating a sample slowly from 25°

C. to 95° C. in presence of a hydrophobic dye (e.g., ProteoStat® Thermal shift stability assay kit, Enzo Life Sciences) that binds to aggregated proteins that are formed as the protein denatures with increasing temperature (Niesen, F. H., Berglund, H. & Vadadi, M., 2007. The use of differential scanning fluorimetry to detect ligand interactions that promote protein stability. *Nature Protocols*, Volume 2, pp. 2212-2221). Upon binding, the dye's fluorescence increases significantly, which is recorded by an rtPCR instrument and represented as the protein's melting curve (Lavinder, J. J., Hari, S. B., Suillivan, B. J. & Magilery, T. J., 2009. High-Throughput Thermal Scanning. A General, Rapid Dye-Binding Thermal Shift Screen for Protein Engineering. *Journal of the American Chemical Society*, pp. 3794-3795). After the thermal shift is complete, samples are examined for insoluble precipitates and further analyzed by analytical size exclusion chromatography (SEC).

In some embodiments a nutritive protein of this disclosure shows resistance to aggregation, exhibiting, for example, less than 80% aggregation, 10% aggregation, or no detectable aggregation at elevated temperatures (e.g, 50° C., 60° C., 70° C., 80° C., 85° C., 90° C., or 95° C.).

One benefit of stable nutritive proteins as disclosed herein is that they may be able to be stored for an extended period of time before use, in some instances without the need for refrigeration or cooling. In some embodiments, nutritive proteins are processed into a dry form (e.g., by lyophilization). In some embodiments, nutritive proteins are stable upon lyophilization. In some embodiments, such lyophilized nutritive proteins maintain their stability upon reconstitution (e.g., liquid formulation).

For most embodiments it is preferred that the nutritive protein not exhibit inappropriately high allergenicity. Accordingly, in some embodiments the potential allergenicy of the nutritive protein is assessed. This can be done by any suitable method known in the art. In some embodiments an allergenicity score is calculated. The allergenicity score is a primary sequence based metric based on WHO recommendations (http://www.fao.org/ag/agn/food/pdf/allergygm.pdf) for assessing how similar a protein is to any known allergen, the primary hypothesis being that high percent identity between a target and a known allergen is likely indicative of cross reactivity. For a given protein, the likelihood of eliciting an allergic response can be assessed via one or both of a complimentary pair of sequence homology based tests. The first test determines the protein's percent identity across the entire sequence via a global-global sequence alignment to a database of known allergens using the FASTA algorithm with the BLOSUM50 substitution matrix, a gap open penalty of 10, and a gap extension penalty of 2. It has been suggested that proteins with less than 50% global homology are unlikely to be allergenic (Goodman R. E. et al. Allergenicity assessment of genetically modified crops—what makes sense? Nat. Biotech. 26, 73-81 (2008); Aalberse R. C. Structural biology of allergens. J. Allergy Clin. Immunol. 106, 228-238 (2000)).

In some embodiments of a nutritive protein, the nutritive protein has less than 50% global homology to any known allergen in the database used for the analysis. In some embodiments a cutoff of less than 40% homology is used. In some embodiments a cutoff of less than 30% homology is used. In some embodiments a cutoff of less than 20% homology is used. In some embodiments a cutoff of less than 10% homology is used. In some embodiments a cutoff of from 40% to 50% is used. In some embodiments a cutoff of from 30% to 50% is used. In some embodiments a cutoff of from 20% to 50% is used. In some embodiments a cutoff of from 10% to 50% is used. In some embodiments a cutoff of from 5% to 50% is used. In some embodiments a cutoff of from 0% to 50% is used. In some embodiments a cutoff of greater than 50% global homology to any known allergen in the database used for the analysis is used. In some embodiments a cutoff of from 50% to 60% is used. In some embodiments a cutoff of from 50% to 70% is used. In some embodiments a cutoff of from 50% to 80% is used. In some embodiments a cutoff of from 50% to 90% is used. In some embodiments a cutoff of from 55% to 60% is used. In some embodiments a cutoff of from 65% to 70% is used. In some embodiments a cutoff of from 70% to 75% is used. In some embodiments a cutoff of from 75% to 80% is used.

The second test assesses the local allergenicity along the protein sequence by determining the local allergenicity of all possible contiguous 80 amino acid fragments via a global-local sequence alignment of each fragment to a database of known allergens using the FASTA algorithm with the BLOSUM50 substitution matrix, a gap open penalty of 10, and a gap extension penalty of 2. The highest percent identity of any 80 amino acid window with any allergen is taken as the final score for the protein of interest. The WHO guidelines suggest using a 35% identity cutoff with this fragment test. In some embodiments of a nutritive protein, all possible fragments of the nutritive protein have less than 35% local homology to any known allergen in the database used for the analysis using this test. In some embodiments a cutoff of less than 30% homology is used. In some embodiments a cutoff of from 30% to 35% homology is used. In some embodiments a cutoff of from 25% to 30% homology is used. In some embodiments a cutoff of from 20% to 25% homology is used. In some embodiments a cutoff of from 15% to 20% homology is used. In some embodiments a cutoff of from 10% to 15% homology is used. In some embodiments a cutoff of from 5% to 10% homology is used. In some embodiments a cutoff of from 0% to 5% homology is used. In some embodiments a cutoff of greater than 35% homology is used. In some embodiments a cutoff of from 35% to 40% homology is used. In some embodiments a cutoff of from 40% to 45% homology is used. In some embodiments a cutoff of from 45% to 50% homology is used. In some embodiments a cutoff of from 50% to 55% homology is used. In some embodiments a cutoff of from 55% to 60% homology is used. In some embodiments a cutoff of from 65% to 70% homology is used. In some embodiments a cutoff of from 70% to 75% homology is used. In some embodiments a cutoff of from 75% to 80% homology is used.

Skilled artisans are able to identify and use a suitable database of known allergens for this purpose. In some embodiments the database is custom made by selecting proteins from more than one database source. In some embodiments the custom database comprises pooled allergen lists collected by the Food Allergy Research and Resource Program (http://www.allergenonline.org/), UNIPROT annotations (http://www.uniprot.org/docs/allergen), and the Structural Database of Allergenic Proteins (SDAP, http://fermi.utmb.edu/SDAP/sdap_lnk.html). This database includes all currently recognized allergens by the International Union of Immunological Socieities (IUIS, http://www.allergen.org/) as well as a large number of additional allergens not yet officially named. In some embodiments the database comprises a subset of known allergen proteins available in known databases; that is, the database is a custom selected subset of known allergen proteins. In some embodiments the database of known allergens comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known allergens comprises from 100 to 500 proteins, from 200 to 1,000 proteins, from 500 to 1,000 proteins, from 500 to 1,000 proteins, or from 1,000 to 2,000 proteins.

In some embodiments all (or a selected subset) of contiguous amino acid windows of different lengths (e.g., 70, 60, 50, 40, 30, 20, 10, 8 or 6 amino acid windows) of a nutritive protein are tested against the allergen database and peptide sequences that have 100% identity, 95% or higher identity, 90% or higher identity, 85% or higher identity, 80% or higher identity, 75% or higher identity, 70% or higher identity, 65% or higher identity, 60% or higher identity, 55% or higher identity, or 50% or higher identity matches are identified for further examination of potential allergenicity.

Another method of predicting the allergenicity of a protein is to assess the homology of the protein to a protein of human origin. The human immune system is exposed to a multitude of possible allergenic proteins on a regular basis and has the intrinsic ability to differentiate between the host body's proteins and exogenous proteins. The exact nature of this ability is not always clear, and there are many diseases that arise as a result of the failure of the body to differentiate self from non-self (e.g. arthritis). Nonetheless, the fundamental hypothesis is that proteins that share a degree of sequence homology to human proteins are less likely to elicit an immune response. In particular, it has been shown that for some protein families with known allergenic members (tropomyosins, parvalbumins, caseins), those proteins that bear more sequence homology to their human counterparts relative to known allergenic proteins, are not thought to be allergenic (Jenkins J A. et al. Evolutionary distance from human homologs reflects allergenicity of animcal food proteins. J. Allergy Clin Immunol. 120 (2007): 1399-1405). For a given protein, a human homology score is measured by determining the maximum percent identity of the protein to a database of human proteins (e.g., the UNIPROT database) from a global-local alignment using the FASTA algorithm with the BLOSUM50 substitution matrix, a gap open penalty of 10, and a gap extension penalty of 2. According to Jenkins et al. (Jenkins J A. et al. Evolutionary distance from human homologs reflects allergenicity of animal food proteins. J. Allergy Clin Immunol. 120 (2007): 1399-1405) proteins with a sequence identity to a human protein above about 62% are less likely to be allergenic. Skilled artisans are able to identify and use a suitable database of known human proteins for this purpose, for example, by searching the UNIPROT database (http://www.uniprot.org). In some embodiments the database is custom made by selecting proteins from more than one database source. Of course the database may but need not be comprehensive. In some embodiments the database comprises a subset of human proteins; that is, the database is a custom selected subset of human proteins. In some embodiments the database of human proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins. In some embodiments the database comprises at least 90%, at least 95%, or at least 99% of all known human proteins.

In some embodiments of a nutritive protein, the nutritive protein is at least 20% homologous to a human protein. In some embodiments a cutoff of at least 30% homology is used. In some embodiments a cutoff of at least 40% homology is used. In some embodiments a cutoff of at least 50% homology is used. In some embodiments a cutoff of at least 60% homology is used. In some embodiments a cutoff of at least 70% homology is used. In some embodiments a cutoff of at least 80% homology is used. In some embodiments a cutoff of at least 62% homology is used. In some embodiments a cutoff of from at least 20% homology to at least 30% homology is used. In some embodiments a cutoff of from at least 30% homology to at least 40% homology is used. In some embodiments a cutoff of from at least 50% homology to at least 60% homology is used. In some embodiments a cutoff of from at least 60% homology to at least 70% homology is used. In some embodiments a cutoff of from at least 70% homology to at least 80% homology is used.

For most embodiments it is preferred that the nutritive protein not exhibit inappropriately high toxicity. Accordingly, in some embodiments the potential toxicity of the nutritive protein is assessed. This can be done by any suitable method known in the art. In some embodiments a toxicity score is calculated by determining the protein's percent identity to databases of known toxic proteins (e.g., toxic proteins identified from the UNIPROT database). A global-global alignment of the protein of interest against the database of known toxins is performed using the FASTA algorithm with the BLOSUM50 substitution matrix, a gap open penalty of 10, and a gap extension penalty of 2. In some embodiments of a nutritive protein, the nutritive protein is less than 35% homologous to a known toxin. In some embodiments a cutoff of less than 35% homology is used. In some embodiments a cutoff of from 30% to 35% homology is used. In some embodiments a cutoff of from 25% to 35% homology is used. In some embodiments a cutoff of from 20% to 35% homology is used. In some embodiments a cutoff of from 15% to 35% homology is used. In some embodiments a cutoff of from 10% to 35% homology is used. In some embodiments a cutoff of from 5% to 35% homology is used. In some embodiments a cutoff of from 0% to 35% homology is used. In some embodiments a cutoff of greater than 35% homology is used. In some embodiments a cutoff of from 35% to 40% homology is used. In some embodiments a cutoff of from 35% to 45% homology is used. In some embodiments a cutoff of from 35% to 50% homology is used. In some embodiments a cutoff of from 35% to 55% homology is used. In some embodiments a cutoff of from 35% to 60% homology is used. In some embodiments a cutoff of from 35% to 70% homology is used. In some embodiments a cutoff of from 35% to 75% homology is used. In some embodiments a cutoff of from 35% to 80% homology is used. Skilled artisans are able to identify and use a suitable database of known toxins for this purpose, for example, by searching the UNIPROT database (http://www.uniprot.org). In some embodiments the database is custom made by selecting proteins identified as toxins from more than one database source. In some embodiments the database comprises a subset of known toxic proteins; that is, the database is a custom selected subset of known toxic proteins. In some embodiments the database of toxic proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins.

For some embodiments it is preferred that the nutritive protein not exhibit anti-nutritional activity ("anti-nutricity"), i.e., proteins that have the potential to prevent the absorption of nutrients from food. Examples of anti-nutritive factors include protease inhibitors, which inhibit the actions of trypsin, pepsin and other proteases in the gut, preventing the digestion and subsequent absorption of protein. Accordingly, in some embodiments the potential anti-nutricity of the nutritive protein is assessed. This can be done by any suitable method known in the art. In some embodiments an anti-nutricity score is calculated by determining the protein's percent identity to databases of known protease inhibitors (e.g., protease inhibitors identified from the UNIPROT database). A global-global alignment of the protein of interest against the database of known protease inhibitors is performed using the FASTA algorithm with the BLOSUM50 substitution matrix, a gap open penalty of 10, and a gap extension penalty of 2, to identify whether the nutritive protein is homologous to a known anti-nutritive protein. In some embodiments of a nutritive protein, the nutritive protein has less than 35% global homology to any known anti-nutritive protein (e.g., any known protease inhibitor) in the database used for the analysis. In some embodiments a cutoff of less than 35% identify is used. In some embodiments a cutoff of from 30% to 35% is used. In some embodiments a cutoff of from 25% to 35% is used. In some embodiments a cutoff of from 20% to 35% is used. In some embodiments a cutoff of from 15% to 35% is used. In some embodiments a cutoff of from 10% to 35% is used. In some embodiments a cutoff of from 5% to 35% is used. In some embodiments a cutoff of from 0% to 35% is used. In some embodiments a cutoff of greater than 35% identify is used. In some embodiments a cutoff of from 35% to 40% is used. In some embodiments a cutoff of from 35% to 45% is used. In some embodiments a cutoff of from 35% to 50% is used. In some embodiments a cutoff of from 35% to 55% is used. In some embodiments a cutoff of from 35% to 60% is used. In some embodiments a cutoff of from 35% to 70% is used. In some embodiments a cutoff of from 35% to 75% is used. In some embodiments a cutoff of from 35% to 80% is used. Skilled artisans are able to identify and use a suitable database of known protease inhibitors for this purpose, for example, by searching the UNIPROT database (http://www.uniprot.org). In some embodiments the database is custom made by selecting proteins identified protease-inhibitors as from more than one database source. In some embodiments the database comprises a subset of known protease inhibitors available in databases; that is, the database is a custom selected subset of known protease inhibitor proteins. In some embodiments the database of known protease inhibitor proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known protease inhibitor proteins comprises from 100 to 500 proteins, from 200 to 1,000 proteins, from 500 to 1,000 proteins, from 500 to 1,000 proteins, or from 1,000 to 2,000 proteins, or from 2,000 to 3,000 proteins.

In other embodiments a nutritive protein that does exhibit some degree of protease inhibitor activity is used. For example, in some embodiments such a protein may be useful because it delays protease digestion when the nuttirive protein is consumed such that the nutritive protein traverse a greater distance within the GI tract before it is digested, thus delaying absorption. For example, in some embodiments the nutritive protein inhibits gastric digestion but not intestinal digestion.

Delaney B. et al. (Evaluation of protein safety in the context of agricultural biotechnology. Food. Chem. Toxicol. 46 (2008: S71-S97)) suggests that one should avoid both known toxic and anti-nutritive proteins when assessing the safety of a possible food protein. In some embodiments of a nutritive protein, the nutritive protein has a favorably low level of global homology to a database of known toxic proteins and/or a favorably low level of global homology to a database of known anti-nutricity proteins (e.g., protease inhibitors), as defined herein.

One feature that can enhance the utility of a nutritive protein is its charge (or per amino acid charge). Nutritive proteins with higher charge can in some embodiments exhibit desirable characteristics such as increased solubility, increased stability, resistance to aggregation, and desirable taste profiles. For example, a charged nutritive protein that exhibits enhanced solubility can be formulated into a beverage or liquid formulation that includes a high concentration of nutritive protein in a relatively low volume of solution, thus delivering a large dose of protein nutrition per unit volume. A charged nutritive protein that exhibits enhanced solubility can be useful, for example, in sports drinks or recovery drinks wherein a user (e.g., an athlete) wants to ingest nutritive protein before, during or after physical activity. A charged nutritive protein that exhibits enhanced solubility can also be particularly useful in a clinical setting wherein a subject (e.g., a patient or an elderly person) is in need of protein nutrition but is unable to ingest solid foods or large volumes of liquids.

For example, the net charge ($Charge_P$) of a polypeptide at pH 7 can be calculated using the following formula:

$$Charge_P = -0.002 - (C)(0.045) - (D)(0.999) - (E)(0.998) + (H)(0.091) + (K)(1.0) + (R)(1.0) - (Y)(-0.001)$$

where C is the number of cysteine residues, D is the number of aspartic acid residues, E is the number of glutamic acid residues, H is the number of histidine residues, K is the number of lysine residues, R is the number of arginine residues and Y is the number of tyrosine residues in the polypeptide. The per amino acid charge ($Charge_A$) of the polypeptide can be calculated by dividing the net charge ($Charge_P$) by the number of amino acid residues (N), i.e., Charge$_A$=Charge$_P$/N. (See Bassi S (2007), "A Primer on Python for Life Science Researchers." *PLoS Comput Biol* 3(11): e199. doi:10.1371/journal.pcbi.0030199).

One metric for assessing the hydrophilicity and potential solubility of a given protein is the solvation score. Solvation score is defined as the total free energy of solvation (i.e. the free energy change associated with transfer from gas phase to a dilute solution) for all amino acid side chains if each residue were solvated independently, normalized by the total number of residues in the sequence. The side chain solvation free energies are found computationally by calculating the electrostatic energy difference between a vacuum dielectric of 1 and a water dielectric of 80 (by solving the Poisson-Boltzmann equation) as well as the non-polar, Van der Waals energy using a linear solvent accessible surface area model (D. Sitkoff, K. A. Sharp, B. Honig. "Accurate Calculation of Hydration Free Energies Using Macroscopic Solvent Models". J. Phys. Chem. 98, 1994). For amino acids with ionizable sidechains (Arg, Asp, Cys, Glu, His, Lys and Tyr), an average solvation free energy is used based on the relative probabilities for each ionization state at the specified pH. Solvation scores start at 0 and continue into negative values, and the more negative the solvation score, the more hydrophilic and potentially soluble the protein is predicted to be. In some embodiments of a nutritive protein, the nutritive protein has a solvation score of −10 or less at pH 7. In some embodiments of a nutritive protein, the nutritive protein has a solvation score of −15 or less at pH 7. In some embodiments of a nutritive protein, the nutritive protein has a solvation score of −20 or less at pH 7. In some embodiments of a nutritive protein, the nutritive protein has a solvation score of −25 or less at pH 7. In some embodiments of a nutritive protein, the nutritive protein has a solvation score of −30 or less at pH 7. In some embodiments of a nutritive protein, the nutritive protein has a solvation score of −35 or less at pH 7. In some embodiments of a nutritive protein, the nutritive protein has a solvation score of −40 or less at pH 7.

The solvation score is a function of pH by virtue of the pH dependence of the molar ratio of undissociated weak acid ([HA]) to conjugate base ([A$^-$]) as defined by the Henderson-Hasselbalch equation:

$$pH = pKa + \log\left(\frac{[A^-]}{[HA]}\right)$$

All weak acids have different solvation free energies compared to their conjugate bases, and the solvation free energy used for a given residue when calculating the solvation score at a given pH is the weighted average of those two values.

Accordingly, in some embodiments of a nutritive protein, the nutritive protein has a solvation score of −10 or less at an acidic pH. In some embodiments of a nutritive protein, the nutritive protein has a solvation score of −15 or less at an acidic pH. In some embodiments of a nutritive protein, the nutritive protein has a solvation score of −20 or less at an acidic pH. In some embodiments of a nutritive protein, the nutritive protein has a solvation score of −25 or less at an acidic pH. In some embodiments of a nutritive protein, the nutritive protein has a solvation score of −30 or less at an acidic pH. In some embodiments of a nutritive protein, the nutritive protein has a solvation score of −35 or less at an acidic pH. In some embodiments of a nutritive protein, the nutritive protein has a solvation score of −40 or less at acidic pH.

Accordingly, in some embodiments of a nutritive protein, the nutritive protein has a solvation score of −10 or less at a basic pH. In some embodiments of a nutritive protein, the nutritive protein has a solvation score of −15 or less at a basic pH. In some embodiments of a nutritive protein, the nutritive protein has a solvation score of −20 or less at a basic pH. In some embodiments of a nutritive protein, the nutritive protein has a solvation score of −25 or less at a basic pH. In some embodiments of a nutritive protein, the nutritive protein has a solvation score of −30 or less at a basic pH. In some embodiments of a nutritive protein, the nutritive protein has a solvation score of −35 or less at a basic pH. In some embodiments of a nutritive protein, the nutritive protein has a solvation score of −40 or less at basic pH.

Accordingly, in some embodiments of a nutritive protein, the nutritive protein has a solvation score of −10 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −15 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −20 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −25 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −30 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −35 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −40 or less at a pH range selected from 2-3, 3-4, 4-5, 5-6, 6-7, 7-8, 8-9, 9-10, 10-11, and 11-12.

The aggregation score is a primary sequence based metric for assessing the hydrophobicity and likelihood of aggregation of a given protein. Using the Kyte and Doolittle hydrophobity scale (Kyte J, Doolittle R F (May 1982) "A simple method for displaying the hydropathic character of a protein". *J. Mol. Biol.* 157 (1): 105-32), which gives hydrophobic residues positive values and hydrophilic residues negative values, the average hydrophobicity of a protein sequence is calculated using a moving average of five residues. The aggregation score is drawn from the resulting plot by determining the area under the curve for values greater than zero and normalizing by the total length of the protein. The underlying hypothesis is that aggregation is the result of two or more hydrophobic patches coming together to exclude water and reduce surface exposure, and the likelihood that a protein will aggregate is a function of how densely packed its hydrophobic (i.e., aggregation prone) residues are. Aggregation scores start at 0 and continue into positive values, and the smaller the aggregation score, the less hydrophobic and potentially less prone to aggregation the protein is predicted to be. In some embodiments of a nutritive protein, the nutritive protein has an aggregation score of 2 or less. In some embodiments of a nutritive protein, the nutritive protein has an aggregation score of 1.5 or less. In some embodiments of a nutritive protein, the nutritive protein has an aggregation score of 1 or less. In some embodiments of a nutritive protein, the nutritive protein has an aggregation score of 0.9 or less. In some embodiments of a nutritive protein, the nutritive protein has an aggregation score of 0.8 or less. In some embodiments of a nutritive protein, the nutritive protein has an aggregation score of 0.7 or less. In some embodiments of a nutritive protein, the nutritive protein has an aggregation score of 0.6 or less. In some embodiments of a nutritive protein, the nutritive protein has an aggregation score of 0.5 or less. In some embodiments of a nutritive protein, the nutritive protein has an aggregation score of 0.4 or less. In some embodiments of a nutritive protein, the nutritive protein has an aggregation score of 0.3 or less. In some embodiments of a nutritive protein, the nutritive protein has an aggregation score of 0.2 or less. In some embodiments of a nutritive protein, the nutritive protein has an aggregation score of 0.1 or less.

In some cases, soluble expression is desirable because it can increase the amount and/or yield of the nutritive protein and facilitate one or more of the isolation and purification of the nutritive protein. In some embodiments, the nutritive proteins of this disclosure are solubly expressed in the host organism. Solvation score and aggregation score can be used to predict soluble expression of recombinant nutritive proteins in a host organism. As shown in Example 8, this disclosure provides evidence suggesting that nutritive proteins with solvation scores of ≤−20 and aggregation scores of ≤0.75 are more likely to be recombinantly expressed in a particular $E.$ $coli$ expression system. Moreover, the data also suggests that nutritive proteins with solvation scores of ≤−20 and aggregation scores of ≤0.5 are more likely to be solubly expressed in this system. Therefore, in some embodiments the nutritive protein of this disclosure has a solvation score of −20 or less. In some embodiments the nutitive protein has an aggregation score of 0.75 or less. In some embodiments the nutitive protein has an aggregation score of 0.5 or less. In some embodiments the nutritive protein has a solvation score of −20 or less and an aggregation score of 0.75 or less. In some embodiments the nutritive protein has a solvation score of −20 or less and an aggregation score of 0.5 or less.

Certain free amino acids and mixtures of free amino acids are known to have a bitter or otherwise unpleasant taste. In addition, hydrolysates of common proteins (e.g., whey and soy) often have a bitter or unpleasant taste. In some embodiments, nutritive proteins disclosed and described herein do not have a bitter or otherwise unpleasant taste. In some embodiments, nutritive proteins disclosed and described herein have a more acceptable taste as compared to at least one of free amino acids, mixtures of free amino acids, and/or protein hydrolysates. In some embodiments, nutritive proteins disclosed and described herein have a taste that is equal to or exceeds at least one of whey protein.

Proteins are known to have tastes covering the five established taste modalities: sweet, sour, bitter, salty and umami. The taste of a particular protein (or its lack thereof) can be attributed to several factors, including the primary structure, the presence of charged side chains, and the electronic and conformational features of the protein. In some embodiments, nutritive proteins disclosed and described herein are designed to have a desired taste (e.g., sweet, salty, umami) and/or not to have an undesired taste (e.g., bitter, sour). In this context "design" includes, for example, selecting naturally occurring proteins embodying features that achieve the desired taste property, as well as creating muteins of naturally-occurring proteins that have desired taste properties. For example, nutritive proteins can be designed to interact with specific taste receptors, such as sweet receptors (T1R2-T1R3 heterodimer) or umami receptors (T1R1-T1R3 heterodimer, mGluR4, and/or mGluR1). Further, nutritive proteins may be designed not to interact, or to have diminished interaction, with other taste receptors, such as bitter receptors (T2R receptors).

Nutritive proteins disclosed and described herein can also elicit different physical sensations in the mouth when ingested, sometimes referred to as "mouth feel". The mouth feel of the nutritive proteins may be due to one or more factors including primary structure, the presence of charged side chains, and the electronic and conformational features of the protein. In some embodiments, nutritive proteins elicit a buttery or fat-like mouth feel when ingested.

In some embodiments the nutritive protein comprises from 20 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 25 amino acids, at least 30 amino acids, at least 35 amino acids, at least 40 amino acids, at least 2455 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids. In some embodiments the nutritive protein consists of from 20 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 25 amino acids, at least 30 amino acids, at least 35 amino acids, at least 40 amino acids, at least 2455 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids.

B. Nucleic Acids

Also provided herein are nucleic acids encoding nutritive polypeptides or proteins. In some embodiments the nucleic acid is isolated. In some embodiments the nucleic acid is purified.

In some embodiments of the nucleic acid, the nucleic acid comprises a nucleic acid sequence that encodes a first polypeptide sequence disclosed in Section A above. In some embodiments of the nucleic acid, the nucleic acid consists of a nucleic acid sequence that encodes a first polypeptide sequence disclosed in Section A above. In some embodiments of the nucleic acid, the nucleic acid comprises a nucleic acid sequence that encodes a nutritive protein disclosed in Section A above. In some embodiments of the nucleic acid, the nucleic acid consists of a nucleic acid sequence that encodes a nutritive protein disclosed in Section A above. In some embodiments of the nucleic acid the nucleic acid sequence that encodes the first polypeptide sequence is operatively linked to at least one expression control sequence. For example, in some embodiments of the nucleic acid the nucleic acid sequence that encodes the first polypeptide sequence is operatively linked to a promoter such as a promoter described in Section D below.

Accordingly, in some embodiments the nucleic acid molecule of this disclosure encodes a polypeptide or protein that itself is a nutritive polypeptide or protein. Such a nucleic acid molecule may be referred to as a "nutrive nucleic acid". In some embodiments the nutritive nucleic acid encodes a polypeptide or protein that itself comprises at least one of: a) a ratio of branch chain amino acid residues to total amino acid residues of at least 24%; b) a ratio of Leu residues to total amino acid residues of at least 11%; and c) a ratio of essential amino acid residues to total amino acid residues of at least 49%. In some embodiments the nutritive nucleic acid comprises at least 10 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, at least 500 nucleotides, at least 600 nucleotides, at least 700 nucleotides, at least 800 nucleotides, at least 900 nucleotides, at least 1,000 nucleotides. In some embodiments the nutritrive nucleic acid comprises from 10 to 100 nucleotides, from 20 to 100 nucleotides, from 10 to 50 nucleotides, or from 20 to 40 nucleotides In some embodiments the nutritive nucleic acid comprises all or part of an open reading frame that encodes a naturally occurring nutritive polypeptide or protein. In some embodiments the nutritive nucleic acid consists of an open reading frame that encodes a fragment of a naturally occurring nutritive protein, wherein the open reading frame does not encode the complete naturally occurring nutritive protein.

In some embodiments the nutritive nucleic acid is a cDNA.

In some embodiments nucleic acid molecules are provided that comprise a sequence that is at least 50%, 60%, 70%, 80%, 85%, 90%, 95%, 96%, 97%, 98%, 99%, or 99.9% identical to a naturally occurring nutritive nucleic acid. In some embodiments nucleic acids are provided that hybridize under stringent hybridization conditions with at least one reference nutritive nucleic acid.

The nutritive nucleic acids and fragments thereof provided in this disclosure display utility in a variety of systems and methods. For example, the fragments may be used as probes in various hybridization techniques. Depending on the method, the target nucleic acid sequences may be either DNA or RNA. The target nucleic acid sequences may be fractionated (e.g., by gel electrophoresis) prior to the hybridization, or the hybridization may be performed on samples in situ. One of skill in the art will appreciate that nucleic acid probes of known sequence find utility in determining chromosomal structure (e.g., by Southern blotting) and in measuring gene expression (e.g., by Northern blotting). In such experiments, the sequence fragments are preferably detectably labeled, so that their specific hybridization to target sequences can be detected and optionally quantified. One of skill in the art will appreciate that the nucleic acid fragments of this disclosure may be used in a wide variety of blotting techniques not specifically described herein.

It should also be appreciated that the nucleic acid sequence fragments disclosed herein also find utility as probes when immobilized on microarrays. Methods for creating microarrays by deposition and fixation of nucleic acids onto support substrates are well known in the art. Reviewed in DNA Microarrays: A Practical Approach (Practical Approach Series), Schena (ed.), Oxford University Press (1999) (ISBN: 0199637768); Nature Genet. 21(1) (suppl):1-60 (1999); Microarray Biochip: Tools and Technology, Schena (ed.), Eaton Publishing Company/BioTechniques Books Division (2000) (ISBN: 1881299376), the disclosures of which are incorporated herein by reference in their entireties. Analysis of, for example, gene expression using microarrays comprising nucleic acid sequence fragments, such as the nucleic acid sequence fragments disclosed herein, is a well-established utility for sequence fragments in the field of cell and molecular biology. Other uses for sequence fragments immobilized on microarrays are described in Gerhold et al., Trends Biochem. Sci. 24:168-173 (1999) and Zweiger, Trends Biotechnol. 17:429-436 (1999); DNA Microarrays: A Practical Approach (Practical Approach Series), Schena (ed.), Oxford University Press (1999) (ISBN: 0199637768); Nature Genet. 21(1)(suppl):1-60 (1999); Microarray Biochip: Tools and Technology, Schena (ed.), Eaton Publishing Company/BioTechniques Books Division (2000) (ISBN: 1881299376).

C. Vectors

Also provided are vectors, including expression vectors, which comprise at least one of the nucleic acid molecules disclosed herein, as described further herein. In some embodiments, the vectors comprise at least one isolated nucleic acid molecule encoding a nutritive protein as disclosed herein. In alternative embodiments, the vectors comprise such a nucleic acid molecule operably linked to one or more expression control sequence. The vectors can thus be used to express at least one recombinant protein in a recombinant microbial host cell.

Suitable vectors for expression of nucleic acids in microorganisms are well known to those of skill in the art. Suitable vectors for use in cyanobacteria are described, for example, in Heidorn et al., "Synthetic Biology in Cyanobacteria: Engineering and Analyzing Novel Functions," Methods in Enzymology, Vol. 497, Ch. 24 (2011). Exemplary replicative vectors that can be used for engineering cyanobacteria as disclosed herein include pPMQAK1, pSL1211, pFC1, pSB2A, pSCR119/202, pSUN119/202, pRL2697, pRL25C, pRL1050, pSG111M, and pPBH201.

Other vectors such as pJB161 which are capable of receiving nucleic acid sequences disclosed herein may also be used. Vectors such as pJB161 comprise sequences which are homologous with sequences present in plasmids endogenous to certain photosynthetic microorganisms (e.g., plasmids pAQ1, pAQ3, and pAQ4 of certain *Synechococcus* species). Examples of such vectors and how to use them is known in the art and provided, for example, in Xu et al., "Expression of Genes in Cyanobacteria: Adaptation of Endogenous Plasmids as Platforms for High-Level Gene Expression in *Synechococcus* sp. PCC 7002," Chapter 21 in Robert Carpenter (ed.), "Photosynthesis Research Protocols," Methods in Molecular Biology, Vol. 684, 2011, which is hereby incorporated herein by reference. Recombination between pJB161 and the endogenous plasmids in vivo yield engineered microbes expressing the genes of interest from their endogenous plasmids. Alternatively, vectors can be engineered to recombine with the host cell chromosome, or the vector can be engineered to replicate and express genes of interest independent of the host cell chromosome or any of the host cell's endogenous plasmids.

A further example of a vector suitable for recombinant protein production is the pET system (Novagen®). This system has been extensively characterized for use in *E. coli* and other microorganisms. In this system, target genes are cloned in pET plasmids under control of strong bacteriophage T7 transcription and (optionally) translation signals; expression is induced by providing a source of T7 RNA polymerase in the host cell. T7 RNA polymerase is so selective and active that, when fully induced, almost all of the microorganism's resources are converted to target gene expression; the desired product can comprise more than 50% of the total cell protein a few hours after induction. It is also possible to attenuate the expression level simply by lowering the concentration of inducer. Decreasing the expression level may enhance the soluble yield of some target proteins. In some embodiments this system also allows for maintenance of target genes in a transcriptionally silent un-induced state.

In some embodiments of using this system, target genes are cloned using hosts that do not contain the T7 RNA polymerase gene, thus alleviating potential problems related to plasmid instability due to the production of proteins potentially toxic to the host cell. Once established in a non-expression host, target protein expression may be initiated either by infecting the host with λCE6, a phage that carries the T7 RNA polymerase gene under the control of the λpL and pI promoters, or by transferring the plasmid into an expression host containing a chromosomal copy of the T7 RNA polymerase gene under lacUV5 control. In the second case, expression is induced by the addition of IPTG or lactose to the bacterial culture or using an autoinduction medium. Other plasmids systems that are controlled by the lac operator, but do not require the T7 RNA polymerase gene and rely upon *E. coil*'s native RNA polymerase include the pTrc plasmid suite (Invitrogen) or pQE plasmid suite (QIAGEN).

In other embodiments it is possible to clone directly into expression hosts. Two types of T7 promoters and several hosts that differ in their stringency of suppressing basal expression levels are available, providing great flexibility and the ability to optimize the expression of a wide variety of target genes.

Suitable vectors for expression of nucleic acids in mammalian cells typically comprise control functions provided by viral regulatory elements. For example, commonly used promoters are derived from polyoma virus, Adenovirus 2, cytomegalovirus, or Simian Virus 40.

D. Promoters

Promoters useful for expressing the recombinant genes described herein include both constitutive and inducible/repressible promoters. Examples of inducible/repressible promoters include nickel-inducible promoters (e.g., PnrsA, PnrsB; see, e.g., Lopez-Mauy et al., Cell (2002) v.43: 247-256) and urea repressible promoters such as PnirA (described in, e.g., Qi et al., Applied and Environmental Microbiology (2005) v.71: 5678-5684). Additional examples of inducible/repressible promoters include PnirA (promoter that drives expression of the nirA gene, induced by nitrate and repressed by urea) and Psuf (promoter that drives expression of the sufB gene, induced by iron stress). Examples of constitutive promoters include Pcpc (promoter that drives expression of the cpc operon), Prbc (promoter that drives expression of rubisco), PpsbAII (promoter that drives expression of PpsbAII), Pcro (lambda phage promoter that drives expression of cro). In other embodiments, a PaphII and/or a lacIq-Ptrc promoter can used to control expression. Where multiple recombinant genes are expressed in an engineered microorganism, the different genes can be controlled by different promoters or by identical promoters in separate operons, or the expression of two or more genes may be controlled by a single promoter as part of an operon.

Further non-limiting examples of inducible promoters may include, but are not limited to, those induced by expression of an exogenous protein (e.g., T7 RNA polymerase, SP6 RNA polymerase), by the presence of a small molecule (e.g., IPTG, galactose, tetracycline, steroid hormone, abscisic acid), by absence of small molecules (e.g., $CO_2$, iron, nitrogen), by metals or metal ions (e.g., copper, zinc, cadmium, nickel), and by environmental factors (e.g., heat, cold, stress, light, darkness), and by growth phase. In some embodiments, the inducible promoter is tightly regulated such that in the absence of induction, substantially no transcription is initiated through the promoter. In some embodiments, induction of the promoter does not substantially alter transcription through other promoters. Also, generally speaking, the compound or condition that induces an inducible promoter is not be naturally present in the organism or environment where expression is sought.

In some embodiments, the inducible promoter is induced by limitation of $CO_2$ supply to a cyanobacteria culture. By way of non-limiting example, the inducible promoter may be the promoter sequence of *Synechocystis* PCC 6803 that are up-regulated under the $CO_2$-limitation conditions, such as the cmp genes, ntp genes, ndh genes, sbt genes, chp genes, and rbc genes, or a variant or fragment thereof.

In some embodiments, the inducible promoter is induced by iron starvation or by entering the stationary growth phase. In some embodiments, the inducible promoter may be variant sequences of the promoter sequence of cyanobacterial genes that are up-regulated under Fe-starvation conditions such as isiA, or when the culture enters the stationary growth phase, such as isiA, phrA, sigC, sigB, and sigH genes, or a variant or fragment thereof.

In some embodiments, the inducible promoter is induced by a metal or metal ion. By way of non-limiting example, the inducible promoter may be induced by copper, zinc, cadmium, mercury, nickel, gold, silver, cobalt, and bismuth or ions thereof. In some embodiments, the inducible promoter is induced by nickel or a nickel ion. In some embodiments, the inducible promoter is induced by a nickel ion, such as $Ni^{2+}$. In another exemplary embodiment, the inducible promoter is the nickel inducible promoter from *Synechocystis* PCC 6803. In another embodiment, the inducible promoter may be induced by copper or a copper ion. In yet another embodiment, the inducible promoter may be induced by zinc or a zinc ion. In still another embodiment, the inducible promoter may be induced by cadmium or a cadmium ion. In yet still another embodiment, the inducible promoter may be induced by mercury or a mercury ion. In an alternative embodiment, the inducible promoter may be induced by gold or a gold ion. In another alternative embodiment, the inducible promoter may be induced by silver or a silver ion. In yet another alternative embodiment, the inducible promoter may be induced by cobalt or a cobalt ion. In still another alternative embodiment, the inducible promoter may be induced by bismuth or a bismuth ion.

In some embodiments, the promoter is induced by exposing a cell comprising the inducible promoter to a metal or metal ion. The cell may be exposed to the metal or metal ion by adding the metal to the microbial growth media. In certain embodiments, the metal or metal ion added to the microbial growth media may be efficiently recovered from the media. In other embodiments, the metal or metal ion remaining in the media after recovery does not substantially impede downstream processing of the media or of the bacterial gene products.

Further non-limiting examples of constitutive promoters include constitutive promoters from Gram-negative bacteria or a bacteriophage propagating in a Gram-negative bacterium. For instance, promoters for genes encoding highly expressed Gram-negative gene products may be used, such as the promoter for Lpp, OmpA, rRNA, and ribosomal proteins. Alternatively, regulatable promoters may be used in a strain that lacks the regulatory protein for that promoter. For instance $P_{lac}$, $P_{tac}$, and $P_{trc}$, may be used as constitutive promoters in strains that lack LacI. Similarly, P22 $P_R$ and $P_L$ may be used in strains that lack the lambda C2 repressor protein, and lambda $P_R$ and $P_L$ may be used in strains that lack the lambda C1 repressor protein. In one embodiment, the constitutive promoter is from a bacteriophage. In another embodiment, the constitutive promoter is from a *Salmonella* bacteriophage. In yet another embodiment, the constitutive promoter is from a cyanophage. In some embodiments, the constitutive promoter is a *Synechocystis* promoter. For instance, the constitutive promoter may be the PpsbAII promoter or its variant sequences, the Prbc promoter or its variant sequences, the $P_{cpc}$ promoter or its variant sequences, and the PrnpB promoter or its variant sequences.

E. Host Cells

Also provided are host cells transformed with the nucleic acid molecules or vectors disclosed herein, and descendants thereof. In some embodiments the host cells are microbial cells. In some embodiments, the host cells carry the nucleic acid sequences on vectors, which may but need not be freely replicating vectors. In other embodiments, the nucleic acids have been integrated into the genome of the host cells and/or into an endogenous plasmid of the host cells. The transformed host cells find use, e.g., in the production of recombinant nutritive proteins disclosed herein.

"Microorganisms" includes prokaryotic and eukaryotic microbial species from the Domains Archaea, Bacteria and Eucarya, the latter including yeast and filamentous fungi, protozoa, algae, or higher Protista. The terms "microbial cells" and "microbes" are used interchangeably with the term microorganism.

A variety of host microorganisms may be transformed with a nucleic acid sequence disclosed herein and may in some embodiments be used to produce a recombinant nutritive protein disclosed herein. Suitable host microorganisms include both autotrophic and heterotrophic microbes. In some applications the autotrophic microorganisms allows for a reduction in the fossil fuel and/or electricity inputs required to make a nutritive protein encoded by a recombinant nucleic acid sequence introduced into the host microorganism. This, in turn, in some applications reduces the cost and/or the environmental impact of producing the nutritive protein and/or reduces the cost and/or the environmental impact in comparison to the cost and/or environmental impact of manufacturing alternative nutritive proteins, such as whey, egg, and soy. For example, the cost and/or environmental impact of making a nutritive protein disclosed herein using a host microorganism as disclosed herein is in some embodiments lower that the cost and/or environmental impact of making whey protein in a form suitable for human consumption by processing of cows milk.

Non-limiting examples of heterotrophs include *Escherichia coli, Salmonella typhimurium, Bacillus subtilis, Bacillus megaterium, Corynebacterium glutamicum, Streptomyces coelicolor, Streptomyces lividans, Streptomyces vanezuelae, Streptomyces roseosporus, Streptomyces fradiae, Streptomyces griseus, Streptomyces calvuligerus, Streptomyces hygroscopicus, Streptomyces platensis, Saccharopolyspora erythraea, Corynebacterium glutamicum, Aspergillus niger, Aspergillus nidulans, Aspergillus oryzae, Aspergillus terreus, Aspergillus sojae, Penicillium chrysogenum, Trichoderma reesei, Clostridium acetobutylicum, Clostridium beijerinckii, Clostridium thermocellum, Fusibacter paucivorans, Saccharomyces cerevisiae, Saccharomyces boulardii, Pichia pastoris*, and *Pichia stipitis*.

Photoautotrophic microorganisms include eukaryotic algae, as well as prokaryotic cyanobacteria, green-sulfur bacteria, green non-sulfur bacteria, purple sulfur bacteria, and purple non-sulfur bacteria.

Extremophiles are also contemplated as suitable organisms. Such organisms withstand various environmental parameters such as temperature, radiation, pressure, gravity, vacuum, desiccation, salinity, pH, oxygen tension, and chemicals. They include hyperthermophiles, which grow at or above 80° C. such as *Pyrolobus fumarii*; thermophiles, which grow between 60-80° C. such as *Synechococcus lividis*; mesophiles, which grow between 15-60° C.; and psychrophiles, which grow at or below 15° C. such as *Psychrobacter* and some insects. Radiation tolerant organisms include *Deinococcus radiodurans*. Pressure-tolerant organisms include piezophiles, which tolerate pressure of 130 MPa. Weight-tolerant organisms include barophiles. Hypergravity (e.g., >1 g) hypogravity (e.g., <1 g) tolerant organisms are also contemplated. Vacuum tolerant organisms include tardigrades, insects, microbes and seeds. Dessicant tolerant and anhydrobiotic organisms include xerophiles such as *Artemia salina*; nematodes, microbes, fungi and lichens. Salt-tolerant organisms include halophiles (e.g., 2-5 M NaCl) *Halobacteriacea* and *Dunaliella salina*. pH-tolerant organisms include alkaliphiles such as *Natronobacterium, Bacillus firmus* OF4, *Spirulina* spp. (e.g., pH>9) and acidophiles such as *Cyanidium caldarium, Ferroplasma* sp. (e.g., low pH). Anaerobes, which cannot tolerate $O_2$ such as *Methanococcus jannaschii*; microaerophils, which tolerate some $O_2$ such as *Clostridium* and aerobes, which require $O_2$ are also contemplated. Gas-tolerant organisms, which tolerate pure $CO_2$ include *Cyanidium caldarium* and metal tolerant organisms include metalotolerants such as *Ferroplasma acidarmanus* (e.g., Cu, As, Cd, Zn), *Ralstonia* sp. CH34 (e.g., Zn, Co, Cd, Hg, Pb). Gross, Michael. *Life on the Edge: Amazing Creatures Thriving in Extreme Environments*. New York: Plenum (1998) and Seckbach, J. "Search for Life in the Universe with Terrestrial Microbes Which Thrive Under Extreme Conditions." In Cristiano Batalli Cosmovici, Stuart Bowyer, and Dan Wertheimer, eds.,

*Astronomical and Biochemical Origins and the Search for Life in the Universe*, p. 511. Milan: Editrice Compositori (1997).

Mixotrophic organisms are also suitable organisms. Mixotrophic organisms can utilize a mix of different sources of energy and carbon, for example, photo- and chemotrophy, litho- and organotrophy, auto- and heterotrophy, and combinations thereof or a combination of it. Mixotrophs can be either eukaryotic or prokaryotic. Additionally, mixotrophs can be obligate or facultative. Suitable mixotrophic organisms include mixotrophic algae and mixotrophic bacteria.

Algae and cyanobacteria include but are not limited to the following genera: *Acanthoceras, Acanthococcus, Acaryochloris, Achnanthes, Achnanthidium, Actinastrum, Actinochloris, Actinocyclus, Actinotaenium, Amphichrysis, Amphidinium, Amphikrikos, Amphipleura, Amphiprora, Amphithrix, Amphora, Anabaena, Anabaenopsis, Aneumastus, Ankistrodesmus, Ankyra, Anomoeoneis, Apatococcus, Aphanizomenon, Aphanocapsa, Aphanochaete, Aphanothece, Apiocystis, Apistonema, Arthrodesmus, Artherospira, Ascochloris, Asterionella, Asterococcus, Audouinella, Aulacoseira, Bacillaria, Balbiania, Bambusina, Bangia, Basichlamys, Batrachospermum, Binuclearia, Bitrichia, Blidingia, Botrdiopsis, Botrydium, Botryococcus, Botryosphaerella, Brachiomonas, Brachysira, Brachytrichia, Brebissonia, Bulbochaete, Bumilleria, Bumilleriopsis, Caloneis, Calothrix, Campylodiscus, Capsosiphon, Carteria, Catena, Cavinula, Centritractus, Centronella, Ceratium, Chaetoceros, Chaetochloris, Chaetomorpha, Chaetonella, Chaetonema, Chaetopeltis, Chaetophora, Chaetosphaeridium, Chamaesiphon, Chara, Characiochloris, Characiopsis, Characium, Charales, Chilomonas, Chlainomonas, Chlamydoblepharis, Chlamydocapsa, Chlamydomonas, Chlamydomonopsis, Chlamydomyxa, Chlamydonephris, Chlorangiella, Chlorangiopsis, Chlorella, Chlorobotrys, Chlorobrachis, Chlorochytrium, Chlorococcum, Chlorogloea, Chlorogloeopsis, Chlorogonium, Chlorolobion, Chloromonas, Chlorophysema, Chlorophyta, Chlorosaccus, Chlorosarcina, Choricystis, Chromophyton, Chromulina, Chroococcidiopsis, Chroococcus, Chroodactylon, Chroomonas, Chroothece, Chrysamoeba, Chrysapsis, Chrysidiastrum, Chrysocapsa, Chrysocapsella, Chrysochaete, Chrysochromulina, Chrysococcus, Chrysocrinus, Chrysolepidomonas, Chrysolykos, Chrysonebula, Chrysophyta, Chrysopyxis, Chrysosaccus, Chrysophaerella, Chrysostephanosphaera, Clodophora, Clastidium, Closteriopsis, Closterium, Coccomyxa, Cocconeis, Coelastrella, Coelastrum, Coelosphaerium, Coenochloris, Coenococcus, Coenocystis, Colacium, Coleochaete, Collodictyon, Compsogonopsis, Compsopogon, Conjugatophyta, Conochaete, Coronastrum, Cosmarium, Cosmioneis, Cosmocladium, Crateriportula, Craticula, Crinalium, Crucigenia, Crucigeniella, Cryptoaulax, Cryptomonas, Cryptophyta, Ctenophora, Cyanodictyon, Cyanonephron, Cyanophora, Cyanophyta, Cyanothece, Cyanothomonas, Cyclonexis, Cyclostephanos, Cyclotella, Cylindrocapsa, Cylindrocystis, Cylindrospermum, Cylindrotheca, Cymatopleura, Cymbella, Cymbellonitzschia, Cystodinium Dactylococcopsis, Debarya, Denticula, Dermatochrysis, Dermocarpa, Dermocarpella, Desmatractum, Desmidium, Desmococcus, Desmonema, Desmosiphon, Diacanthos, Diacronema, Diadesmis, Diatoma, Diatomella, Dicellula, Dichothrix, Dichotomococcus, Dicranochaete, Dictyochloris, Dictyococcus, Dictyosphaerium, Didymocystis, Didymogenes, Didymosphenia, Dilabifilum, Dimorphococcus, Dinobryon, Dinococcus, Diplochloris, Diploneis, Diplostauron, Distrionella, Docidium, Draparnaldia, Dunaliella, Dysmorphoccus, Ecballocystis, Elakatothrix, Ellerbeckia, Encyonema, Enteromorpha, Entocladia, Entomoneis, Entophysalis, Epichrysis, Epipyxis, Epithemia, Eremosphaera, Euastropsis, Euastrum, Eucapsis, Eucocconeis, Eudorina, Euglena, Euglenophyta, Eunotia, Eustigmatophyta, Eutreptia, Fallacia, Fischerella, Fragilaria, Fragilariforma, Franceia, Frustulia, Curcilla, Geminella, Genicularia, Glaucocystis, Glaucophyta, Glenodiniopsis, Glenodinium, Gloeocapsa, Gloeochaete, Gloeochrysis, Gloeococcus, Gloeocystis, Gloeodendron, Gloeomonas, Gloeoplax, Gloeothece, Gloeotila, Gloeotrichia, Gloiodictyon, Golenkinia, Golenkiniopsis, Gomontia, Gomphocymbella, Gomphonema, Gomphosphaeria, Gonatozygon, Gongrosia, Gongrosira, Goniochloris, Gonium, Gonyostomum, Granulochloris, Granulocystopsis, Groenbladia, Gymnodinium, Gymnozyga, Gyrosigma, Haematococcus, Hafniomonas, Hallassia, Hammatoidea, Hannaea, Hantzschia, Hapalosiphon, Haplotaenium, Haptophyta, Haslea, Hemidinium, Hemitoma, Heribaudiella, Heteromastix, Heterothrix, Hibberdia, Hildenbrandia, Hillea, Holopedium, Homoeothrix, Hormanthonema, Hormotila, Hyalobrachion, Hyalocardium, Hyalodiscus, Hyalogonium, Hyalotheca, Hydrianum, Hydrococcus, Hydrocoleum, Hydrocoryne, Hydrodictyon, Hydrosera, Hydrurus, Hyella, Hymenomonas, Isthmochloron, Johannesbaptistia, Juranyiella, Karayevia, Katablepharis, Katodinium, Kephyrion, Keratococcus, Kirchneriella, Klebsormidium, Kolbesia, Koliella, Komarekia, Korshikoviella, Kraskella, Lagerheimia, Lagynion, Lamprothamnium, Lemanea, Lepocinclis, Leptosira, Lobococcus, Lobocystis, Lobomonas, Luticola, Lyngbya, Malleochloris, Mallomonas, Mantoniella, Marssoniella, Martyana, Mastigocoleus, Gastogloia, Melosira, Merismopedia, Mesostigma, Mesotaenium, Micractinium, Micrasterias, Microchaete, Microcoleus, Microcystis, Microglena, Micromonas, Microspora, Microthamnion, Mischococcus, Monochrysis, Monodus, Monomastix, Monoraphidium, Monostroma, Mougeotia, Mougeotiopsis, Myochloris, Myromecia, Myxosarcina, Naegeliella, Nannochloris, Nautococcus, Navicula, Neglectella, Neidium, Nephroclamys, Nephrocytium, Nephrodiella, Nephroselmis, Netrium, Nitella, Nitellopsis, Nitzschia, Nodularia, Nostoc, Ochromonas, Oedogonium, Oligochaetophora, Onychonema, Oocardium, Oocystis, Opephora, Ophiocytium, Orthoseira, Oscillatoria, Oxyneis, Pachycladella, Palmella, Palmodictyon, Pnadorina, Pannus, Paralia, Pascherina, Paulschulzia, Pediastrum, Pedinella, Pedinomonas, Pedinopera, Pelagodictyon, Penium, Peranema, Peridiniopsis, Peridinium, Peronia, Petroneis, Phacotus, Phacus, Phaeaster, Phaeodermatium, Phaeophyta, Phaeosphaera, Phaeothamnion, Phormidium, Phycopeltis, Phyllariochloris, Phyllocardium, Phyllomitas, Pinnularia, Pitophora, Placoneis, Planctonema, Planktosphaeria, Planothidium, Plectonema, Pleodorina, Pleurastrum, Pleurocapsa, Pleurocladia, Pleurodiscus, Pleurosigma, Pleurosira, Pleurotaenium, Pocillomonas, Podohedra, Polyblepharides, Polychaetophora, Polyedriella, Polyedriopsis, Polygoniochloris, Polyepidomonas, Polytaenia, Polytoma, Polytomella, Porphyridium, Posteriochromonas, Prasinochloris, Prasinocladus, Prasinophyta, Prasiola, Prochlorphyta, Prochlorothrix, Protoderma, Protosiphon, Provasoliella, Prymnesium, Psammodictyon, Psammothidium, Pseudanabaena, Pseudenoclonium, Psuedocarteria, Pseudochate, Pseudocharacium, Pseudococcomyxa, Pseudodictyosphaerium, Pseudokephyrion, Pseudoncobyrsa, Pseudoquadrigula, Pseudosphaerocystis, Pseudostaurastrum, Pseudostaurosira, Pseudotetrastrum, Pteromonas, Punctastruata, Pyramichlamys, Pyramimonas, Pyrrophyta, Quadrichloris,*

*Quadricoccus, Quadrigula, Radiococcus, Radiofilum, Raphidiopsis, Raphidocelis, Raphidonema, Raphidophyta, Peimeria, Rhabdoderma, Rhabdomonas, Rhizoclonium, Rhodomonas, Rhodophyta, Rhoicosphenia, Rhopalodia, Rivularia, Rosenvingiella, Rossithidium, Roya, Scenedesmus, Scherffelia, Schizochlamydella, Schizochlamys, Schizomeris, Schizothrix, Schroederia, Scolioneis, Scotiella, Scotiellopsis, Scourfieldia, Scytonema, Selenastrum, Selenochloris, Sellaphora, Semiorbis, Siderocelis, Diderocystopsis, Dimonsenia, Siphononema, Sirocladium, Sirogonium, Skeletonema, Sorastrum, Spennatozopsis, Sphaerellocystis, Sphaerellopsis, Sphaerodinium, Sphaeroplea, Sphaerozosma, Spiniferomonas, Spirogyra, Spirotaenia, Spirulina, Spondylomorum, Spondylosium, Sporotetras, Spumella, Staurastrum, Stauerodesmus, Stauroneis, Staurosira, Staurosirella, Stenopterobia, Stephanocostis, Stephanodiscus, Stephanoporos, Stephanosphaera, Stichococcus, Stichogloea, Stigeoclonium, Stigonema, Stipitococcus, Stokesiella, Strombomonas, Stylochrysalis, Stylodinium, Styloyxis, Stylosphaeridium, Surirella, Sykidion, Symploca, Synechococcus, Synechocystis, Synedra, Synochromonas, Synura, Tabellaria, Tabularia, Teilingia, Temnogametum, Tetmemorus, Tetrachlorella, Tetracyclus, Tetradesmus, Tetraedriella, Tetraedron, Tetraselmis, Tetraspora, Tetrastrum, Thalassiosira, Thamniochaete, Thorakochloris, Thorea, Tolypella, Tolypothrix, Trachelomonas, Trachydiscus, Trebouxia, Trentepholia, Treubaria, Tribonema, Trichodesmium, Trichodiscus, Trochiscia, Tryblionella, Ulothrix, Uroglena, Uronema, Urosolenia, Urospora, Uva, Vacuolaria, Vaucheria, Volvox, Volvulina, Westella, Woloszynskia, Xanthidium, Xanthophyta, Xenococcus, Zygnema, Zygnemopsis,* and *Zygonium.*

Additional cyanobacteria include members of the genus *Chamaesiphon, Chroococcus, Cyanobacterium, Cyanobium, Cyanothece, Dactylococcopsis, Gloeobacter, Gloeocapsa, Gloeothece, Microcystis, Prochlorococcus, Prochloron, Synechococcus, Synechocystis, Cyanocystis, Dermocarpella, Stanieria, Xenococcus, Chroococcidiopsis, Myxosarcina, Arthrospira, Borzia, Crinalium, Geitlerinemia, Leptolyngbya, Limnothrix, Lyngbya, Microcoleus, Oscillatoria, Planktothrix, Prochlorothrix, Pseudanabaena, Spirulina, Starria, Symploca, Trichodesmium, Tychonema, Anabaena, Anabaenopsis, Aphanizomenon, Cyanospira, Cylindrospermopsis, Cylindrospermum, Nodularia, Nostoc, Scylonema, Calothrix, Rivularia, Tolypothrix, Chlorogloeopsis, Fischerella, Geitieria, Iyengariella, Nostochopsis, Stigonema* and *Thermosynechococcus.*

Green non-sulfur bacteria include but are not limited to the following genera: *Chloroflexus, Chloronema, Oscillochloris, Heliothrix, Herpetosiphon, Roseiflexus,* and *Thermomicrobium.*

Green sulfur bacteria include but are not limited to the following genera: *Chlorobium, Clathrochloris,* and *Prosthecochloris.*

Purple sulfur bacteria include but are not limited to the following genera: *Allochromatium, Chromatium, Halochromatium, Isochromatium, Marichromatium, Rhodovulum, Thermochromatium, Thiocapsa, Thiorhodococcus,* and *Thiocystis.*

Purple non-sulfur bacteria include but are not limited to the following genera: *Phaeospirillum, Rhodobaca, Rhodobacter, Rhodomicrobium, Rhodopila, Rhodopseudomonas, Rhodothalassium, Rhodospirillum, Rodovibrio,* and *Roseospira.*

Aerobic chemolithotrophic bacteria include but are not limited to nitrifying bacteria such as *Nitrobacteraceae* sp., *Nitrobacter* sp., *Nitrospina* sp., *Nitrococcus* sp., *Nitrospira* sp., *Nitrosomonas* sp., *Nitrosococcus* sp., *Nitrosospira* sp., *Nitrosolobus* sp., *Nitrosovibrio* sp.; colorless sulfur bacteria such as, *Thiovulum* sp., *Thiobacillus* sp., *Thiomicrospira* sp., *Thiosphaera* sp., *Thermothrix* sp.; obligately chemolithotrophic hydrogen bacteria such as *Hydrogenobacter* sp., iron and manganese-oxidizing and/or depositing bacteria such as *Siderococcus* sp., and magnetotactic bacteria such as *Aquaspirillum* sp.

Archaeobacteria include but are not limited to methanogenic archaeobacteria such as *Methanobacterium* sp., *Methanobrevibacter* sp., *Methanothermus* sp., *Methanococcus* sp., *Methanomicrobium* sp., *Methanospirillum* sp., *Methanogenium* sp., *Methanosarcina* sp., *Methanolobus* sp., *Methanothrix* sp., *Methanococcoides* sp., *Methanoplanus* sp.; extremely thermophilic S-Metabolizers such as *Thermoproteus* sp., *Pyrodictium* sp., *Sulfolobus* sp., *Acidianus* sp. and other microorganisms such as, *Bacillus subtilis, Saccharomyces cerevisiae, Streptomyces* sp., *Ralstonia* sp., *Rhodococcus* sp., *Corynebacteria* sp., *Brevibacteria* sp., *Mycobacteria* sp., and oleaginous yeast.

Yet other suitable organisms include synthetic cells or cells produced by synthetic genomes as described in Venter et al. US Pat. Pub. No. 2007/0264688, and cell-like systems or synthetic cells as described in Glass et al. US Pat. Pub. No. 2007/0269862.

Still other suitable organisms include *Escherichia coli, Acetobacter aceti, Bacillus subtilis,* yeast and fungi such as *Clostridium ljungdahlii, Clostridium thermocellum, Penicillium chrysogenum, Pichia pastoris, Saccharomyces cerevisiae, Schizosaccharomyces pombe, Pseudomonas fluorescens,* or *Zymomonas mobilis.* In some embodiments those organisms are engineered to fix carbon dioxide while in other embodiments they are not.

In some embodiments eukaryotic cells, such as insect cells or mammalian cells, such as human cells are used as host cells. Vectors and expression control sequences including promoters and enhancers are well known for such cells. Examples of useful mammalian host cell lines for this purpose are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/–DHFR(CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

F. Production of Nutritive Proteins

Skilled artisans are aware of many suitable methods available for culturing recombinant cells to produce (and optionally secrete) a recombinant nutritive protein as disclosed herein, as well as for purification and/or isolation of expressed recombinant proteins. The methods chosen for protein purification depend on many variables, including the properties of the protein of interest, its location and form within the cell, the vector, host strain background, and the intended application for the expressed protein. Culture conditions can also have an effect on solubility and localization of a given target protein. Many approaches can be used to purify target proteins expressed in recombinant microbial cells as disclosed herein, including without limitation ion exchange and gel filtration.

In some embodiments a peptide fusion tag is added to the recombinant protein making possible a variety of affinity purification methods that take advantage of the peptide fusion tag. In some embodiments, the use of an affinity method enables the purification of the target protein to near homogeneity in one step. Purification may include cleavage of part or all of the fusion tag with enterokinase, factor Xa, thrombin, or HRV 3C proteases, for example. In some embodiments, before purification or activity measurements of an expressed target protein, preliminary analysis of expression levels, cellular localization, and solubility of the target protein is performed. The target protein may be found in any or all of the following fractions: soluble or insoluble cytoplasmic fractions, periplasm, or medium. Depending on the intended application, preferential localization to inclusion bodies, medium, or the periplasmic space can be advantageous, in some embodiments, for rapid purification by relatively simple procedures.

While *Escherichia coli* is widely regarded as a robust host for heterologous protein expression, it is also widely known that over-expression of many proteins in this host is prone to aggregation in the form of insoluble inclusion bodies. One of the most commonly used methods for either rescuing inclusion body formation, or to improve the titer of the protein itself, is to include an amino-terminal maltose-binding protein (MBP) [Austin B P, Nallamsetty S, Waugh D S. Hexahistidine-tagged maltose-binding protein as a fusion partner for the production of soluble recombinant proteins in *Escherichia coli*. Methods Mol. Biol. 2009; 498:157-72], or small ubiquitin-related modifier (SUMO) [Saitoh H, Uwada J, Azusa K. Strategies for the expression of SUMO-modified target proteins in *Escherichia coli*. Methods Mol. Biol. 2009; 497:211-21; Malakhov M P, Mattern M R, Malakhova O A, Drinker M, Weeks S D, Butt T R. SUMO fusions and SUMO-specific protease for efficient expression and purification of proteins. J Struct Funct Genomics. 2004; 5(1-2):75-86; Panavas T, Sanders C, Butt T R. SUMO fusion technology for enhanced protein production in prokaryotic and eukaryotic expression systems. Methods Mol. Biol. 2009; 497:303-17] fusion to the protein of interest. These two proteins are expressed extremely well, and in the soluble form, in *Escherichia coli* such that the protein of interest is also effectively produced in the soluble form. The protein of interest can be cleaved by designing a site specific protease recognition sequence (such as the tobacco etch virus (TEV) protease) in-between the protein of interest and the fusion protein [1].

In some embodiments the recombinant protein is initially not folded correctly or is insoluble. A variety of methods are well known for refolding of insoluble proteins. Most protocols comprise the isolation of insoluble inclusion bodies by centrifugation followed by solubilization under denaturing conditions. The protein is then dialyzed or diluted into a non-denaturing buffer where refolding occurs. Because every protein possesses unique folding properties, the optimal refolding protocol for any given protein can be empirically determined by a skilled artisan. Optimal refolding conditions can, for example, be rapidly determined on a small scale by a matrix approach, in which variables such as protein concentration, reducing agent, redox treatment, divalent cations, etc., are tested. Once the optimal concentrations are found, they can be applied to a larger scale solubilization and refolding of the target protein.

In some embodiments the nutritive protein does not comprise a tertiary structure. In some embodiments less than half of the amino acids in the nutritive protein participate in a tertiary structure. In some embodiments the nutritive protein does not comprise a secondary structure. In some embodiments less than half of the amino acids in the nutritive protein participate in a secondary structure. Recombinant nutritive proteins may be isolated from a culture of cells expressing them in a state that comprises one or more of these structural features. In some embodiments the tertiary structure of a recombinant nutritive protein is reduced or eliminated after the protein is isolated from a culture producing it. In some embodiments the secondary structure of a recombinant nutritive protein is reduced or eliminated after the protein is isolated from a culture producing it.

In some embodiments a CAPS buffer at alkaline pH in combination with N-lauroylsarcosine is used to achieve solubility of the inclusion bodies, followed by dialysis in the presence of DTT to promote refolding. Depending on the target protein, expression conditions, and intended application, proteins solubilized from washed inclusion bodies may be >90% homogeneous and may not require further purification. Purification under fully denaturing conditions (before refolding) is possible using His•Tag® fusion proteins and His•Bind® immobilized metal affinity chromatography (Novogen®). In addition, S•Tag™, T7•Tag®, and Strep•Tag® II fusion proteins solubilized from inclusion bodies using 6 M urea can be purified under partially denaturing conditions by dilution to 2 M urea (S•Tag™ and T7•Tag) or 1 M urea (Strep•Tag II) prior to chromatography on the appropriate resin. Refolded fusion proteins can be affinity purified under native conditions using His•Tag, S•Tag, Strep•Tag II, and other appropriate affinity tags (e.g., GST•Tag™, and T7•Tag) (Novogen®).

In some embodiments the recombinant nutritive protein is an endogenous protein of the host cell used to express it. That is, the cellular genome of the host cell comprises an open reading frame that encodes the recombinant nutritive protein. In some embodiments regulatory sequences sufficient to increase expression of the nutritive protein are inserted into the host cell genome and operatively linked to the endogenous open reading frame such that the regulatory sequences drive overexpression of the recombinant nutritive protein from a recombinant nucleic acid. In some embodiments heterologous nucleic acid sequences are fused to the endogenous open reading frame of the nutritive protein and cause the nutritive protein to be synthesized comprising a hetgerologous amino acid sequence that changes the cellular trafficking of the recombinant nutritive protein, such as directing it to an organelle or to a secretion pathway. In some embodiments an open reading frame that encodes the endogeneous host cell protein is introduced into the host cell on a plasmid that further comprises regulatory sequences operatively linked to the open reading frame. In some embodiments the recombinant host cell expresses at least 2 times, at least 3 times, at least 4 times, at least 5 times, at least 10 times, or at least 20 times, at least 30 times, at least 40 times, at least 50 times, or at least 100 times more of the recombinant nutritive protein than the amount of the nutritive protein produced by a similar host cell grown under similar conditions.

In some embodiments nutritive proteins of this disclosure are synthesized chemically without the use of a recombinant production system. Protein synthesis can be carried out in a liquid-phase system or in a solid-phase system using techniques known in the art (see, e.g., Atherton, E., Sheppard, R.

C. (1989). *Solid Phase peptide synthesis: a practical approach*. Oxford, England: IRL Press; Stewart, J. M., Young, J. D. (1984). Solid phase peptide synthesis (2nd ed.). Rockford: Pierce Chemical Company).

G. Production of Recombinant Nutritive Proteins in Plants

The nucleic acid molecules comprising a nucleic acid sequence encoding a nutritive protein of this disclosure enable production of transgenic plants comprising the nucleic acid sequence. Accordingly, this disclosure also provides plant comprising a recombinant nucleic acid molecule comprising a nucleic acid sequence encoding a nutritive protein of this disclosure. The plant can be any plant that is subject to transformation and regeneration and include, but are not limited to, Acacia, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassaya, cauliflower, celery, Chinese cabbage, cherry, cilantro, citrus, clementines, coffee, corn, cotton, cucumber, Douglas fir, eggplant, endive, escarole, eucalyptus, fennel, figs, forest trees, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, rapeseed, raspberry, rice, rye, sorghum, Southern pine, soybean, spinach, squash, strawberry, sugarbeet, sugarcane, sunflower, sweet corn, sweet potato, sweetgum, tangerine, tea, tobacco, tomato, turf, a vine, watermelon, wheat, yams, and zucchini. In preferred embodiments, the plant is a bean, broccoli, cabbage, canola, carrot, cauliflower, celery, Chinese cabbage, corn, cotton cucumber, eggplant, leek, lettuce, melon, pea, pepper, pumpkin, radish, spinach, soybean, squash, sugarcane, sweet corn, tomato, watermelon, and wheat plant. In some embodiments, the plant is a corn plant. In some embodiments, the plant is a soybean plant. In some embodiments, the plant is a cotton plant. In some embodiments, the plant is a canola plant. In some embodiments the plant is a member of a genus selected from *Arabidopsis, Beta, Glycine, Jatropha, Miscanthus, Panicum, Phalaris, Populus, Saccharum, Salix, Simmondsia* and *Zea*.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens*, caulimovirus promoters such as the cauliflower mosaic virus. For instance, see U.S. Pat. Nos. 5,858,742 and 5,322,938, which disclose versions of the constitutive promoter derived from cauliflower mosaic virus (CaMV35S), U.S. Pat. No. 5,641, 876, which discloses a rice actin promoter, U.S. Patent Application Publication 2002/0192813A1, which discloses 5', 3' and intron elements useful in the design of effective plant expression vectors, U.S. patent application Ser. No. 09/757,089, which discloses a maize chloroplast aldolase promoter, U.S. patent application Ser. No. 08/706,946, which discloses a rice glutelin promoter, U.S. patent application Ser. No. 09/757,089, which discloses a maize aldolase (FDA) promoter, and U.S. patent application Ser. No. 60/310,370, which discloses a maize nicotianamine synthase promoter. These and numerous other promoters that function in plant cells are known to those skilled in the art and available for use in recombinant nucleic acids to provide for expression of nutritive proteins in transgenic plants.

For some applications preferential expression in plant green tissues is desired. Promoters of interest for such uses include those from genes such as *Arabidopsis thaliana* ribulose-1,5-bisphosphate carboxylase (Rubisco) small subunit (Fischhoff et al. (1992) Plant Mol. Biol. 20:81-93), aldolase and pyruvate orthophosphate dikinase (PPDK) (Taniguchi et al. (2000) Plant Cell Physiol. 41(1):42-48).

Furthermore, the promoters may be altered to contain at least one enhancer sequence to assist in elevating gene expression. Such enhancers are known in the art. By including an enhancer sequence with such constructs, the expression of the nutrive protein may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

For some applications expression in plant seed tissues is desired to effect modify seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) Transgenic Res. 6(2):157-166), globulin 1 (Belanger et al (1991) Genetics 129:863-872), glutelin 1 (Russell (1997) supra), and peroxiredoxin antioxidant (Per1) (Stacy et al. (1996) Plant Mol. Biol. 31(6): 1205-1216)

Recombinant nucleic acid constructs prepared in accordance with the disclosure will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627; 3' elements from plant genes such as wheat (*Triticum aesevitum*) heat shock protein 17 (Hsp17 3'), a wheat ubiquitin gene, a wheat fructose-1,6-biphosphatase gene, a rice glutelin gene a rice lactate dehydrogenase gene and a rice beta-tubulin gene, all of which are disclosed in U.S. published patent application 2002/0192813 A1; and the pea (*Pisum sativum*) ribulose biphosphate carboxylase gene (rbs 3'), and 3' elements from the genes within the host plant.

Constructs and vectors may also include a transit peptide for targeting of a gene target to a plant organelle, particularly to a chloroplast, leucoplast or other plastid organelle. For descriptions of the use of chloroplast transit peptides see U.S. Pat. Nos. 5,188,642 and 5,728,925. For description of the transit peptide region of an *Arabidopsis* EPSPS gene, see Klee, H. J. et al (MGG (1987) 210:437-442).

Numerous methods for transforming plant cells with recombinant DNA are known in the art and may be used in the present disclosure. Two commonly used methods for plant transformation are *Agrobacterium*-mediated transformation and microprojectile bombardment. Microprojectile bombardment methods are illustrated in U.S. Pat. No. 5,015, 580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and *Agrobacterium*-mediated transformation is described in U.S. Pat. No. 5,159, 135 (cotton); U.S. Pat. No. 5,824,877 (soybean); U.S. Pat. No. 5,591,616 (corn); and U.S. Pat. No. 6,384,301 (soybean). For *Agrobacterium tumefaciens* based plant transformation system, additional elements present on transformation constructs will include T-DNA left and right border sequences to facilitate incorporation of the recombinant polynucleotide into the plant genome.

In general it is useful to introduce recombinant DNA randomly, i.e. at a non-specific location, in the genome of a target plant line. In special cases it may be useful to target recombinant DNA insertion in order to achieve site-specific integration, for example to replace an existing gene in the genome, to use an existing promoter in the plant genome, or to insert a recombinant polynucleotide at a predetermined site known to be active for gene expression. Several site specific recombination systems exist which are known to function in plants, including cre-lox as disclosed in U.S. Pat. No. 4,959,317 and FLP-FRT as disclosed in U.S. Pat. No. 5,527,695.

Transformation methods are generally practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, seedling apical meristems, microspores and the like. Cells capable of proliferating as callus are also recipient cells for genetic transformation. Practical transformation methods and materials for making transgenic plants of this disclosure, for example various media and recipient target cells, transformation of immature embryo cells and subsequent regeneration of fertile transgenic plants are disclosed in U.S. Pat. Nos. 6,194,636 and 6,232,526.

The seeds of transgenic plants can be harvested from fertile transgenic plants and used to grow progeny generations of transformed plants that produce the recombinant nutritive protein of this disclosure. In addition to direct transformation of a plant with a recombinant DNA, transgenic plants can be prepared by crossing a first plant having a recombinant DNA with a second plant lacking the DNA. For example, recombinant DNA can be introduced into first plant line that is amenable to transformation to produce a transgenic plant which can be crossed with a second plant line to introgress the recombinant DNA into the second plant line. A transgenic plant with recombinant DNA encoding a nutritive protein of this disclosure, can be crossed with transgenic plant line having other recombinant DNA that confers another trait, for example herbicide resistance or pest resistance, or production of a second nutritive product such as an oil, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In the practice of transformation DNA is typically introduced into only a small percentage of target plant cells in any one transformation experiment. Marker genes are used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the herbicides to which the transformed plants may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (nptII), hygromycin B (aph IV) and gentamycin (aac3 and aacC4) or resistance to herbicides such as glufosinate (bar or pat) and glyphosate (aroA or EPSPS). Examples of such selectable are illustrated in U.S. Pat. Nos. 5,550,318; 5,633,435; 5,780,708 and 6,118,047. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber. Plants are regenerated from about 6 weeks to 10 months after a transformant is identified, depending on the initial tissue. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of a heterologous nutritive protein.

Transgenic plants derived from the plant cells of this disclosure are grown to generate transgenic plants comprising the heterologous nucleic acid that encodes a nutritive protein of this disclosure and produce transgenic seed and haploid pollen comprising the heterologous nucleic acid sequence. Such plants with enhanced traits are identified by selection of transformed plants or progeny seed for the enhanced trait. Transgenic plants grown from transgenic seed provided herein demonstrate improved agronomic traits that contribute to increased yield or other traits that provide increased plant value, including, for example, improved protein quality such as increasing the content of at least one of essential amino acids, branch chain amino acids, or Leu.

The transgenic plants are useful as sources of nutritive proteins. For example, in some embodiments a transgenic plant comprising a recombinant nutritive protein of this disclosure comprises an increased weight fraction of total protein compared to a control non-transgenic plant. In some embodiments a transgenic plant comprising a recombinant nutritive protein of this disclosure comprises an increased weight fraction of essential amino acids compared to a control non-transgenic plant. In some embodiments a transgenic plant comprising a recombinant nutritive protein of this disclosure comprises an increased weight fraction of branch chain amino acids compared to a control non-transgenic plant. In some embodiments a transgenic plant comprising a recombinant nutritive protein of this disclosure comprises an increased weight fraction of Leu compared to a control non-transgenic plant. In some embodiments a transgenic plant comprising a recombinant nutritive protein of this disclosure comprises at least one of: a) an increased ratio of branch chain amino acid residues to total amino acid residues compared to a control non-transgenic plant; b) an increased ratio of Leu residues to total amino acid residues compared to a control non-transgenic plant; and c) an increased ratio of essential amino acid residues to total amino acid residues compared to a control non-transgenic plant. In some embodiments a transgenic plant comprising a recombinant nutritive protein of this disclosure comprises: a) an increased ratio of branch chain amino acid residues to total amino acid residues compared to a control non-transgenic plant; b) an increased ratio of Leu residues to total amino acid residues compared to a control non-transgenic plant; and c) an increased ratio of essential amino acid residues to total amino acid residues compared to a control non-transgenic plant.

Accordingly, the transgenic plants are useful as sources of high quality protein. The plants may be harvested and used in mammalian diets with or without further processing. For example, flour made from transgenic wheat, cornmeal made from transgenic corn, or rice or rice flour derived from transgenic rice is enriched in at least one of protein, essential amino acids, branch chain amino acids, and Leu compared to similar products made from plants that do not comprise the recombinant nutritive protein. In some embodiments the recombinant nutritive protein is a plant protein or comprises a polypeptide sequence of a plant protein or a derivative or mutein thereof, such as but not necessarily a protein or polypeptide sequence of the same type of plant. In other embodiments the recombinant nutritive protein is not a plant protein or a derivative or mutein thereof.

In some embodiments the recombinant nutritive protein is recovered or partially recovered from the transgenic plant before it is consumed by a mammal.

H. Compositions

At least one nutritive protein disclosed herein may be combined with at least one second component to form a nutritive composition. In some embodiments the only source of amino acid in the composition is the at least one nutritive protein disclosed herein. In such embodiments the amino acid composition of the composition will be the same as the amino acid composition of the at least one nutritive protein disclosed herein. In some embodiments the composition comprises at least one nutritive protein disclosed herein and at least one second protein. In some embodiments the at least one second protein is a second nutritive protein disclosed herein, while in other embodiments the at least one second protein is not a nutritive protein disclosed herein. In some embodiments the composition comprises 1, 2, 3, 4, 5, 6, 7, 8, 9, 10, 11, 12, 13, 14, 15, 16, 17, 18, 19, 20 or more nutritive proteins disclosed herein. In some embodiments the composition comprises 0, 1, 2, 3, 4, 5, 6, 7, 8, 9, 10, 11, 12, 13, 14, 15, 16, 17, 18, 19, 20 or more proteins that are not nutritive proteins disclosed herein. In some embodiments the composition comprises 1, 2, 3, 4, 5, 6, 7, 8, 9, 10, 11, 12, 13, 14, 15, 16, 17, 18, 19, 20 or more nutritive proteins and the composition comprises 0, 1, 2, 3, 4, 5, 6, 7, 8, 9, 10, 11, 12, 13, 14, 15, 16, 17, 18, 19, 20 or more proteins that are not nutritive proteins disclosed herein.

In some embodiments the nutritive composition as described in the preceding paragraph, further comprises at least one of at least one polypeptide, at least one peptide, and at least one free amino acid. In some embodiments the nutritive composition comprises at least one polypeptide and at least one peptide. In some embodiments the nutritive composition comprises at least one polypeptide and at least one free amino acid. In some embodiments the nutritive composition comprises at least one peptide and at least one free amino acid. In some embodiments the at least one polypeptide, at least one peptide, and/or at least one free amino acid comprises amino acids selected from 1) branch chain amino acids, 2) leucine, and 3) essential amino acids. In some embodiments the at least one polypeptide, at least one peptide, and/or at least one free amino acid consists of amino acids selected from 1) branch chain amino acids, 2) leucine, and 3) essential amino acids. In some embodiments, the nutritive composition comprises at least one modified amino acid or a non-standard amino acid. Modified amino acids include amino acids that have modifications to one or more of the carboxy terminus, amino terminus, and/or side chain. Non-standard amino acids may be selected from those that are formed by post-translational modification of proteins, for example, carboxylated glutamate, hydroxyproline, or hypusine. Other non-standard amino acids are not found in proteins. Examples include lanthionine, 2-aminoisobutyric acid, dehydroalanine, gamma-aminobutyric acid, ornithine and citrulline. In some embodiments, the nutritive composition comprises one or more D-amino acids. In some embodiments, the nutritive composition comprises one or more L-amino acids. In some embodiments, the nutritive composition comprises a mixture of one or more D-amino acids and one or more L-amino acids.

By adding at least one of a polypeptide, a peptide, and a free amino acid to a nutritive composition the proportion of at least one of branch chain amino acids, leucine, and essential amino acids, to total amino acid, present in the composition can be increased.

In some embodiments the composition comprises at least one carbohydrate. A "carbohydrate" refers to a sugar or polymer of sugars. The terms "saccharide," "polysaccharide," "carbohydrate," and "oligosaccharide" may be used interchangeably. Most carbohydrates are aldehydes or ketones with many hydroxyl groups, usually one on each carbon atom of the molecule. Carbohydrates generally have the molecular formula $C_nH_{2n}O_n$. A carbohydrate may be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates may contain modified saccharide units such as 2'-deoxyribose wherein a hydroxyl group is removed, 2'-fluororibose wherein a hydroxyl group is replace with a fluorine, or N-acetylglucosamine, a nitrogen-containing form of glucose (e.g., 2'-fluororibose, deoxyribose, and hexose). Carbohydrates may exist in many different forms, for example, conformers, cyclic forms, acyclic forms, stereoisomers, tautomers, anomers, and isomers.

In some embodiments the composition comprises at least one lipid. As used herein a "lipid" includes fats, oils, triglycerides, cholesterol, phospholipids, fatty acids in any form including free fatty acids. Fats, oils and fatty acids may be saturated, unsaturated (cis or trans) or partially unsaturated (cis or trans). In some embodiments the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In some embodiments the composition comprises at least one modified lipid, for example a lipid that has been modified by cooking.

In some embodiments the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In some embodiments the composition comprises at least one supplemental vitamin. The at least one vitamin can be fat-soluble or water soluble vitamins. Suitable vitamins include but are not limited to vitamin C, vitamin A, vitamin E, vitamin B12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In some embodiments the composition comprises at least one organism. Suitable examples are well known in the art and include probiotics (e.g., species of *Lactobacillus* or *Bifidobacterium*), spirulina, chlorella, and *porphyra*.

In some embodiments the composition comprises at least one dietary supplement. Suitable examples are well known in the art and include herbs, botanicals, and certain hormones. Non limiting examples include ginko, gensing, and melatonin.

In some embodiments the composition comprises an excipient. Non-limiting examples of suitable excipients include a buffering agent, a preservative, a stabilizer, a binder, a compaction agent, a lubricant, a dispersion enhancer, a disintegration agent, a flavoring agent, a sweetener, a coloring agent.

In some embodiments the excipient is a buffering agent. Non-limiting examples of suitable buffering agents include sodium citrate, magnesium carbonate, magnesium bicarbonate, calcium carbonate, and calcium bicarbonate.

In some embodiments the excipient comprises a preservative. Non-limiting examples of suitable preservatives include antioxidants, such as alpha-tocopherol and ascorbate, and antimicrobials, such as parabens, chlorobutanol, and phenol.

In some embodiments the composition comprises a binder as an excipient. Non-limiting examples of suitable binders include starches, pregelatinized starches, gelatin, polyvinylpyrrolidone, cellulose, methylcellulose, sodium carboxymethylcellulose, ethylcellulose, polyacrylamides, polyvinyloxoazolidone, polyvinylalcohols, $C_{12}$-$C_{18}$ fatty acid alcohol, polyethylene glycol, polyols, saccharides, oligosaccharides, and combinations thereof.

In some embodiments the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In some embodiments the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments the composition comprises a disintegrant as an excipient. In some embodiments the disintegrant is a non-effervescent disintegrant. Non-limiting examples of suitable non-effervescent disintegrants include starches such as corn starch, potato starch, pregelatinized and modified starches thereof, sweeteners, clays, such as bentonite, micro-crystalline cellulose, alginates, sodium starch glycolate, gums such as agar, guar, locust bean, karaya, pecitin, and tragacanth. In some embodiments the disintegrant is an effervescent disintegrant. Non-limiting examples of suitable effervescent disintegrants include sodium bicarbonate in combination with citric acid, and sodium bicarbonate in combination with tartaric acid.

In some embodiments the excipient comprises a flavoring agent. Flavoring agents incorporated into the outer layer can be chosen from synthetic flavor oils and flavoring aromatics; natural oils; extracts from plants, leaves, flowers, and fruits; and combinations thereof. In some embodiments the flavoring agent is selected from cinnamon oils; oil of wintergreen; peppermint oils; clover oil; hay oil; anise oil; eucalyptus; vanilla; citrus oil such as lemon oil, orange oil, grape and grapefruit oil; and fruit essences including apple, peach, pear, strawberry, raspberry, cherry, plum, pineapple, and apricot.

In some embodiments the excipient comprises a sweetener. Non-limiting examples of suitable sweeteners include glucose (corn syrup), dextrose, invert sugar, fructose, and mixtures thereof (when not used as a carrier); saccharin and its various salts such as the sodium salt; dipeptide sweeteners such as aspartame; dihydrochalcone compounds, glycyrrhizin; *Stevia Rebaudiana* (Stevioside); chloro derivatives of sucrose such as sucralose; and sugar alcohols such as sorbitol, mannitol, sylitol, and the like. Also contemplated are hydrogenated starch hydrolysates and the synthetic sweetener 3,6-dihydro-6-methyl-1,2,3-oxathiazin-4-one-2,2-dioxide, particularly the potassium salt (acesulfame-K), and sodium and calcium salts thereof.

In some embodiments the composition comprises a coloring agent. Non-limiting examples of suitable color agents include food, drug and cosmetic colors (FD&C), drug and cosmetic colors (D&C), and external drug and cosmetic colors (Ext. D&C). The coloring agents can be used as dyes or their corresponding lakes.

The weight fraction of the excipient or combination of excipients in the formulation is usually about 50% or less, about 45% or less, about 40% or less, about 35% or less, about 30% or less, about 25% or less, about 20% or less, about 15% or less, about 10% or less, about 5% or less, about 2% or less, or about 1% or less of the total weight of the amino acids in the composition.

The nutritive proteins and nutritive compositions disclosed herein can be formulated into a variety of forms and administered by a number of different means. The compositions can be administered orally, rectally, or parenterally, in formulations containing conventionally acceptable carriers, adjuvants, and vehicles as desired. The term "parenteral" as used herein includes subcutaneous, intravenous, intramuscular, or intrasternal injection and infusion techniques. In an exemplary embodiment, the nutritive protein or composition is administered orally.

Solid dosage forms for oral administration include capsules, tablets, caplets, pills, troches, lozenges, powders, and granules. A capsule typically comprises a core material comprising a nutritive protein or composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as taste-masking agents.

Tablets, pills, and the like can be compressed, multiply compressed, multiply layered, and/or coated. The coating can be single or multiple. In one embodiment, the coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments the coating material comprises a protein. In some embodiments the coating material comprises at least one of a fat and an oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments the coating material comprises at least one edible wax. The edible wax can be derived from animals, insects, or plants. Non-limiting examples include beeswax, lanolin, bayberry wax, carnauba wax, and rice bran wax. Tablets and pills can additionally be prepared with enteric coatings.

Alternatively, powders or granules embodying the nutritive proteins and nutritive compositions disclosed herein can be incorporated into a food product. In some embodiments the food product is be a drink for oral administration. Non-limiting examples of a suitable drink include fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, creams, pastes, emulsions, suspensions and slurries, each of which may optionally also containing at least one of suitable solvents, preservatives, emulsifying agents, suspending agents, diluents, sweeteners, coloring agents, and flavoring agents.

In some embodiments the food product is a solid foodstuff. Suitable examples of a solid foodstuff include without limitation a food bar, a snack bar, a cookie, a brownie, a muffin, a cracker, a biscuit, a cream or paste, an ice cream bar, a frozen yogurt bar, and the like.

In some embodiments, the nutritive proteins and nutritive compositions disclosed herein are incorporated into a therapeutic food. In some embodiments, the therapeutic food is a ready-to-use food that optionally contains some or all essential macronutrients and micronutrients. In some embodiments, the nutritive proteins and nutritive compositions disclosed herein are incorporated into a supplementary food that is designed to be blended into an existing meal. In some embodiments, the supplemental food contains some or all essential macronutrients and micronutrients. In some embodiments, the nutritive proteins and nutritive compositions disclosed herein are blended with or added to an existing food to fortify the food's protein nutrition. Examples include food staples (grain, salt, sugar, cooking oil, margarine), beverages (coffee, tea, soda, beer, liquor, sports drinks), snacks, sweets and other foods.

The compositions disclosed herein can be utilized in methods to increase at least one of muscle mass, strength and physical function, thermogenesis, metabolic expenditure, satiety, mitochondrial biogenesis, weight or fat loss, and lean body composition for example.

I. Methods of Use

In some embodiments the nutritive proteins and nutritive compositions disclosed herein are administered to a patient or a user (sometimes collectively referred to as a "subject"). As used herein "administer" and "administration" encompasses embodiments in which one person directs another to consume a nutritive protein or nutritive composition in a certain manner and/or for a certain purpose, and also situations in which a user uses a nutritive protein or nutritive composition in a certain manner and/or for a certain purpose independently of or in variance to any instructions received from a second person. Non-limiting examples of embodiments in which one person directs another to consume a nutritive protein or nutritive composition in a certain manner and/or for a certain purpose include when a physician prescribes a course of conduct and/or treatment to a patient, when a trainer advises a user (such as an athlete) to follow a particular course of conduct and/or treatment, and when a manufacturer, distributor, or marketer recommends conditions of use to an end user, for example through advertisements or labeling on packaging or on other materials provided in association with the sale or marketing of a product.

In some embodiments the nutritive proteins or nutritive compositions are provided in a dosage form. In some embodiments the dosage form is designed for administration of at least one nutritive protein disclosed herein, wherein the total amount of nutritive protein administered is selected from 0.1 g to 1 g, 1 g to 5 g, from 2 g to 10 g, from 5 g to 15 g, from 10 g to 20 g, from 15 g to 25 g, from 20 g to 40 g, from 25-50 g, and from 30-60 g.

In some embodiments the dosage form is designed for administration of at least one nutritive protein disclosed herein, wherein the total amount of nutritive protein administered is selected from about 0.1 g, 0.1 g-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the dosage form is designed for administration of at least one nutritive protein disclosed herein, wherein the total amount of essential amino acids administered is selected from 0.1 g to 1 g, from 1 g to 5 g, from 2 g to 10 g, from 5 g to 15 g, from 10 g to 20 g, and from 1-30 g. In some embodiments the dosage form is designed for administration of at least one nutritive protein disclosed herein, wherein the total amount of nutritive protein administered is selected from about 0.1 g, 0.1-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the nutritive protein or nutritive composition is consumed at a rate of from 0.1 g to 1 g a day, 1 g to 5 g a day, from 2 g to 10 g a day, from 5 g to 15 g a day, from 10 g to 20 g a day, from 15 g to 30 g a day, from 20 g to 40 g a day, from 25 g to 50 g a day, from 40 g to 80 g a day, from 50 g to 100 g a day, or more.

In some embodiments, of the total protein intake by the subject, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or about 100% of the total protein intake by the subject over a dietary period is made up of at least one nutritive protein according to this disclosure. In some embodiments, of the total protein intake by the subject, from 5% to 100% of the total protein intake by the subject, from 5% to 90% of the total protein intake by the subject, from 5% to 80% of the total protein intake by the subject, from 5% to 70% of the total protein intake by the subject, from 5% to 60% of the total protein intake by the subject, from 5% to 50% of the total protein intake by the subject, from 5% to 40% of the total protein intake by the subject, from 5% to 30% of the total protein intake by the subject, from 5% to 20% of the total protein intake by the subject, from 5% to 10% of the total protein intake by the subject, from 10% to 100% of the total protein intake by the subject, from 10% to 100% of the total protein intake by the subject, from 20% to 100% of the total protein intake by the subject, from 30% to 100% of the total protein intake by the subject, from 40% to 100% of the total protein intake by the subject, from 50% to 100% of the total protein intake by the subject, from 60% to 100% of the total protein intake by the subject, from 70% to 100% of the total protein intake by the subject, from 80% to 100% of the total protein intake by the subject, or from 90% to 100% of the total protein intake by the subject, over a dietary period, is made up of at least one nutritive protein according to this disclosure. In some embodiments the at least one nutritive protein of this disclosure accounts for at least 5%, at least 10%, at least 15%, at least 20%, at least 25%, at least 30%, at least 35%, at least 40%, at least 45%, or at least 50% of the subject's calorie intake over a dietary period.

In some embodiments the at least one nutritive protein according to this disclosure comprises at least 2 nutritive proteins of this disclosure, at least 3 nutritive proteins of this disclosure, at least 4 nutritive proteins of this disclosure, at least 5 nutritive proteins of this disclosure, at least 6 nutritive proteins of this disclosure, at least 7 nutritive proteins of this disclosure, at least 8 nutritive proteins of this disclosure, at least 9 nutritive proteins of this disclosure, at least 10 nutritive proteins of this disclosure, or more.

In some embodiments the dietary period is 1 meal, 2 meals, 3 meals, at least 1 day, at least 2 days, at least 3 days, at least 4 days, at least 5 days, at least 6 days, at least 1 week, at least 2 weeks, at least 3 weeks, at least 4 weeks, at least 1 month, at least 2 months, at least 3 months, at least 4 months, at least 5 months, at least 6 months, or at least 1 year. In some embodiments the dietary period is from 1 day to 1 week, from 1 week to 4 weeks, from 1 month, to 3 months, from 3 months to 6 months, or from 6 months to 1 year.

Clinical studies provide evidence that protein prevents muscle loss due to aging or bed rest. In particular, studies have shown that protein supplementation increases muscle fractional synthetic rate (FSR) during prolonged bed rest, maintains leg mass and strength during prolonged bed rest, increases lean body mass, improves functional measures of gait and balance, and may serve as a viable intervention for individuals at risk of sarcopenia due to immobility or prolonged bed rest. (See, e.g., Paddon-Jones D, et al. *J Clin Endocrinol Metab* 2004, 89:4351-4358; Ferrando, A et al. *Clinical Nutrition* 2009 1-6; Katsanos C et al. *Am J Physiol Endocrinol Metab.* 2006, 291: 381-387).

Studies on increasing muscle protein anabolism in athletes have shown that protein provided following exercise promotes muscle hypertrophy to a greater extent than that achieved by exercise alone. It has also been shown that protein provided following exercise supports protein synthesis without any increase in protein breakdown, resulting in a net positive protein balance and muscle mass accretion. While muscle protein synthesis appears to respond in a dose-response fashion to essential amino acid supplementation, not all proteins are equal in building muscle. For example, the amino acid leucine is an important factor in stimulating muscle protein synthesis. (See, e.g., Borscheim E et al. *Am J Physiol Endocrinol Metab* 2002, 283: E648-E657; Borsheim E et al. *Clin Nutr.* 2008, 27: 189-95; Esmarck B et al *J Physiol* 2001, 535: 301-311; Moore D et al. *Am J Clin Nutr* 2009, 89: 161-8).

In another aspect this disclosure provides methods of maintaining or increasing at least one of muscle mass, muscle strength, and functional performance in a subject. In some embodiments the methods comprise providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the sufficient amount of a nutritive protein of this disclosure, a nutritive composition of this disclosure, or a nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of maintaining or achieving a desirable body mass index in a subject. In some embodiments the methods comprise providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the sufficient amount of a nutritive protein of this disclosure, a nutritive composition of this disclosure, or a nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of providing protein to a subject with protein-energy malnutrition. In some embodiments the methods comprise providing to the subject a sufficient amount of a nutritive protein of this disclosure, a nutritive composition of this disclosure, or a nutritive composition made by a method of this disclosure. In some embodiments the nutritive protein of this disclosure, nutritive composition of this disclosure, or nutritive composition made by a method of this disclosure is consumed by the subject by an oral, enteral, or parenteral route.

The need for essential amino acid supplementation has been suggested in cancer patients and other patients suffering from cachexia. Dietary studies in mice have shown survival and functional benefits to cachectic cancer-bearing mice through dietary intervention with essential amino acids. Beyond cancer, essential amino acid supplementation has also shown benefits, such as improved muscle function and muscle gain, in patients suffering from other diseases who have difficulty exercising and therefore suffer from muscular deterioration, such as chronic obstructive pulmonary disease, chronic heart failure, HIV, and other disease states.

Studies have shown that specific amino acids have advantages in managing cachexia. A relatively high content of BCAAs and Leu in diets are thought to have a positive effect in cachexia by promoting total protein synthesis by signaling an increase in translation, enhancing insulin release, and inhibiting protein degradation. Thus, consuming increased dietary BCAAs in general and/or Leu in particular will contribute positively to reduce or reverse the effects of cachexia. Because nitrogen balance is important in countering the underlying cause of cachexia it is thought that consuming increased dietary glutamine and/or arginine will contribute positively to reduce or reverse the effects of cachexia. (See, e.g., Op den Kamp C, Langen R, Haegens A, Schols A. "Muscle atrophy in cachexia: can dietary protein tip the balance?" *Current Opinion in Clinical Nutrition and Metabolic Care* 2009, 12:611-616; Poon RT-P, Yu W-C, Fan S-T, et al. "Long-term oral branched chain amino acids in patients undergoing chemoembolization for hepatocellular carcinoma: a randomized trial." *Aliment Pharmacol Ther* 2004; 19:779-788; Tayek J A, Bistrian B R, Hehir D J, Martin R, Moldawer L L, Blackburn G L. "Improved protein kinetics and albumin synthesis by branched chain amino acid-enriched total parenteral nutrition in cancer cachexia." *Cancer.* 1986; 58:147-57; Xi P, Jiang Z, Zheng C, Lin Y, Wu G "Regulation of protein metabolism by glutamine: implications for nutrition and health." *Front Biosci.* 2011 Jan. 1; 16:578-97).

Accordingly, also provided herein are methods of treating cachexia in a subject. In some embodiments a sufficient amount of a nutritive protein of this disclosure, a nutritive composition of this disclosure, or a nutritive composition made by a method of this disclosure for a subject with cachexia is an amount such that the amount of protein of this disclosure ingested by the person meets or exceeds the metabolic needs (which are often elevated). A protein intake of 1.5 g/kg of body weight per day or 15-20% of total caloric intake appears to be an appropriate target for persons with cachexia. In some embodiments all of the protein consumed by the subject is a nutritive protein according to this disclosure. In some embodiments nutritive protein according to this disclosure is combined with other sources of protein and/or free amino acids to provide the total protein intake of the subject. In some embodiments the subject is at least one of elderly, critically-medically ill, and suffering from protein-energy malnutrition. In some embodiments the subject suffers from a disease that makes exercise difficult and therefore causes muscular deterioration, such as chronic obstructive pulmonary disease, chronic heart failure, HIV, cancer, and other disease states. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to this disclosure, the nutritive composition according to disclosure, or the nutritive composition made by a method according to disclosure is consumed by the subject by an oral, enteral, or parenteral route.

Sarcopenia is the degenerative loss of skeletal muscle mass (typically 0.5-1% loss per year after the age of 25), quality, and strength associated with aging. Sarcopenia is a component of the frailty syndrome. The European Working Group on Sarcopenia in Older People (EWGSOP) has developed a practical clinical definition and consensus diagnostic criteria for age-related sarcopenia. For the diagnosis of sarcopenia, the working group has proposed using the presence of both low muscle mass and low muscle function (strength or performance). Sarcopenia is characterized first by a muscle atrophy (a decrease in the size of the muscle), along with a reduction in muscle tissue "quality," caused by such factors as replacement of muscle fibres with fat, an increase in fibrosis, changes in muscle metabolism, oxidative stress, and degeneration of the neuromuscular junction. Combined, these changes lead to progressive loss of muscle function and eventually to frailty. Frailty is a common geriatric syndrome that embodies an elevated risk of catastrophic declines in health and function among older adults. Contributors to frailty can include sarcopenia, osteoporosis, and muscle weakness. Muscle weakness, also known as muscle fatigue, (or "lack of strength") refers to the inability to exert force with one's skeletal muscles. Weakness often follows muscle atrophy and a decrease in activity, such as after a long bout of bedrest as a result of an illness. There is also a gradual onset of muscle weakness as a result of sarcopenia.

The nutritive proteins of this disclosure are useful for treating sarcopenia or frailty once it develops in a subject or for preventing the onset of sarcopenia or frailty in a subject who is a member of an at risk groups. In some embodiments all of the protein consumed by the subject is a nutritive protein according to this disclosure. In some embodiments nutritive protein according to this disclosure is combined with other sources of protein and/or free amino acids to provide the total protein intake of the subject. In some embodiments the subject is at least one of elderly, critically-medically ill, and suffering from protein-energy malnutrition. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to this disclosure, the nutritive composition according to disclosure, or the nutritive composition made by a method according to disclosure is consumed by the subject by an oral, enteral, or parenteral route.

Obesity is a multifactorial disorder associated with a host of comorbidities including hypertension, type 2 diabetes, dyslipidemia, coronary heart disease, stroke, cancer (eg, endometrial, breast, and colon), osteoarthritis, sleep apnea, and respiratory problems. The incidence of obesity, defined as a body mass index >30 kg/m$^2$, has increased dramatically in the United States, from 15% (1976-1980) to 33% (2003-2004), and it continues to grow. Although the mechanisms contributing to obesity are complex and involve the interplay of behavioral components with hormonal, genetic, and metabolic processes, obesity is largely viewed as a lifestyle-dependent condition with 2 primary causes: excessive energy intake and insufficient physical activity. With respect to energy intake, there is evidence that modestly increasing the proportion of protein in the diet, while controlling total energy intake, may improve body composition, facilitate fat loss, and improve body weight maintenance after weight loss. Positive outcomes associated with increased dietary protein are thought to be due primarily to lower energy intake associated with increased satiety, reduced energy efficiency and/or increased thermogenesis, positive effects on body composition (specifically lean muscle mass), and enhanced glycemic control.

Dietary proteins are more effective in increasing postprandial energy expenditure than isocaloric intakes of carbohydrates or fat (see, e.g., Dauncey M, Bingham S. "Dependence of 24 h energy expenditure in man on composition of the nutrient intake." *Br J Nutr* 1983, 50:1-13; Karst H et al. "Diet-induced thermogenesis in man: thermic effects of single proteins, carbohydrates and fats depending on their energy amount." *Ann Nutr Metab.* 1984, 28: 245-52; Tappy L et al "Thermic effect of infused amino acids in healthy humans and in subjects with insulin resistance." *Am J Clin Nutr* 1993, 57 (6): 912-6). This property along with other properties (satiety induction; preservation of lean body mass) make protein an attractive component of diets directed at weight management. The increase in energy expenditure caused by such diets may in part be due to the fact that the energy cost of digesting and metabolizing protein is higher than for other calorie sources. Protein turnover, including protein synthesis, is an energy consuming process. In addition, high protein diets may also up-regulate uncoupling protein in liver and brown adipose, which is positively correlated with increases in energy expenditure. It has been theorized that different proteins may have unique effects on energy expenditure.

Studies suggest that ingestion of protein, particularly proteins with high EAA and/or BCAA content, leads to distinct effects on thermogenesis and energy expenditure (see, e.g., Mikkelsen P. et al. "Effect of fat-reduced diets on 24 h energy expenditure: comparisons between animal protein, vegetable protein and carbohydrate." *Am J Clin Nutr* 2000, 72:1135-41; Acheson K. et al. "Protein choices targeting thermogenesis and metabolism." *Am J Clin Nutr* 2011, 93:525-34; Alfenas R. et al. "Effects of protein quality on appetite and energy metabolism in normal weight subjects" *Arg Bras Endocrinol Metabol* 2010, 54 (1): 45-51; Lorenzen J. et al. "The effect of milk proteins on appetite regulation and diet-induced thermogenesis." *J Clin Nutr* 2012 66 (5): 622-7). Additionally, L-tyrosine has been identified as an amino acid that plays a role in thermogenesis (see, e.g., Belza A. et al. "The beta-adrenergic antagonist propranolol partly abolishes thermogenic response to bioactive food ingredients." *Metabolism* 2009, 58 (8):1137-44). Further studies suggest that Leucine and Arginine supplementation appear to alter energy metabolism by directing substrate to lean body mass rather than adipose tissue (Dulloo A. "The search for compounds that stimulate thermogenesis in obesity management: from pharmaceuticals to functional food ingredients." *Obes Rev* 2011 12: 866-83).

Collectively the literature suggests that different protein types leads to distinct effects on thermogenesis. Because proteins or peptides rich in EAAs, BCAA, and/or at least one of Tyr, Arg, and Leu are believed to have a stimulatory effect on thermogenesis, and because stimulation of thermogenesis is believed to lead to positive effects on weight management, this disclosure also provides products and methods useful to stimulation thermogenesis and/or to bring about positive effects on weight management in general.

More particularly, this disclosure provides methods of increasing thermogenesis in a subject. In some embodiments the methods comprise providing to the subject a sufficient amount of a nutritive protein of this disclosure, a nutritive composition of this disclosure, or a nutritive composition made by a method of this disclosure. In some embodiments the subject is obese. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to disclosure, the nutritive composition according to disclosure, or the nutritive composition made by a method according to disclosure is consumed by the subject by an oral, enteral, or parenteral route.

At the basic level, the reason for the development of an overweight condition is due to an imbalance between energy intake and energy expenditure. Attempts to reduce food at any particular occasion (satiation) and across eating occasions (satiety) have been a major focus of recent research. Reduced caloric intake as a consequence of feeling satisfied during a meal and feeling full after a meal results from a complex interaction of internal and external signals. Various nutritional studies have demonstrated that variation in food properties such as energy density, content, texture and taste influence both satiation and satiety.

There are three macronutrients that deliver energy: fat, carbohydrates and proteins. A gram of protein or carbohydrate provides 4 calories while a gram of fat 9 calories. Protein generally increases satiety to a greater extent than carbohydrates or fat and therefore may facilitate a reduction in calorie intake. However, there is considerable evidence that indicates the type of protein matters in inducing satiety (see, e.g., W. L. Hall, et al. "Casein and whey exert different effects on plasma amino acid profiles, gastrointestinal hormone secretion and appetite." *Br J Nutr.* 2003 February, 89(2):239-48; R. Abou-Samra, et al. "Effect of different protein sources on satiation and short-term satiety when consumed as a starter." *Nutr J.* 2011 Dec. 23, 10:139; T. Akhavan, et al. "Effect of premeal consumption of whey protein and its hydrolysate on food intake and postmeal glycemia and insulin responses in young adults." *Am J Clin Nutr.* 2010 April, 91(4):966-75, Epub 2010 Feb. 17; MA Veldhorst "Dose-dependent satiating effect of whey relative to casein or soy" *Physiol Behav.* 2009 Mar. 23, 96(4-5):675-82). Evidence indicates that protein rich in Leucine is particularly effective at inducing satiety (see, e.g., Fromentin G et al "Peripheral and central mechanisms involved in the control of food intake by dietary amino acids and proteins." Nutr Res Rev 2012 25: 29-39).

In some embodiments a nutritive protein of this disclosure is consumed by a subject concurrently with at least one pharmaceutical or biologic drug product. In some embodiments the beneficial effects of the nutritive protein and the at least one pharmaceutical or biologic drug product have an additive effect while in some embodiments the beneficial effects of the nutritive protein and the at least one pharmaceutical or biologic drug product have a synergistic effect. Examples of pharmaceutical or biologic drug products that can be administered with the nutritive proteins of this disclosure are well known in the art. For example, when a nutritive protein of this disclosure is used to maintain or increase at least one of muscle mass, muscle strength, and functional performance in a subject, the nutritive protein may be consumed by a subject concurrently with a therapeutic dosage regime of at least one pharmaceutical or biologic drug product indicated to maintain or increase at least one of muscle mass, muscle strength, and functional performance in a subject, such as an anabolic steroid. When a nutritive protein of this disclosure is used to maintain or achieve a desirable body mass index in a subject, the nutritive protein may be consumed by a subject concurrently with a therapeutic dosage regime of at least one pharmaceutical or biologic drug product indicated to maintain or achieve a desirable body mass index in a subject, such as orlistat, lorcaserin, sibutramine, rimonabant, metformin, exenatide, or pramlintide. When a nutritive protein of this disclosure is used to induce at least one of a satiation response and a satiety response in a subject, the nutritive protein may be consumed by a subject concurrently with a therapeutic dosage regime of at least one pharmaceutical or biologic drug product indicated to induce at least one of a satiation response and a satiety response in a subject, such as rimonabant, exenatide, or pramlintide. When a nutritive protein of this disclosure is used to treat at least one of cachexia, sarcopenia and frailty in a subject, the nutritive protein may be consumed by a subject concurrently with a therapeutic dosage regime of at least one pharmaceutical or biologic drug product indicated to treat at least one of cachexia, sarcopenia and frailty, such as omega-3 fatty acids or anabolic steroids. Because of the role of dietary protein in inducing satiation and satiety, the nutritive proteins and nutritive compositions disclosed herein can be used to induce at least one of a satiation response and a satiety response in a subject. In some embodiments the methods comprise providing to the subject a sufficient amount of a nutritive protein of this disclosure, a nutritive composition of this disclosure, or a nutritive composition made by a method of this disclosure. In some embodiments the subject is obese. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to disclosure, the nutritive composition according to disclosure, or the nutritive composition made by a method according to disclosure is consumed by the subject by an oral, enteral, or parenteral route.

In some embodiments incorporating a least one nutritive protein or nutritive composition of this disclosure into the diet of a subject has at least one effect selected from inducing postprandial satiety (including by suppressing hunger), inducing thermogenesis, reducing glycemic response, positively affecting energy expenditure positively affecting lean body mass, reducing the weight gain caused by overeating, and decreasing energy intake. In some embodiments incorporating a least one nutritive protein or nutritive composition of this disclosure into the diet of a subject has at least one effect selected from increasing loss of body fat, reducing lean tissue loss, improving lipid profile, and improving glucose tolerance and insulin sensitivity in the subject.

EXAMPLES

The following examples serve to more fully describe the manner of using the invention. These examples are presented for illustrative purposes and should not serve to limit the true scope of the invention.

Example 1

Identification of Naturally Occurring Proteins and Fragments

Naturally occurring proteins and fragments of naturally occurring proteins with useful PDCAAS values and/or similarity to a chosen EAA/NEAA (Whey) target amino acid profile were identified by searching the full set of sequences in the reviewed UniProt database (also known as the SwissProt database). The full database set of proteins was trimmed to proteins that are non-human and non-viral in origin, and do not contain the words "toxic", "toxin", "virus", or "viral" in either the protein or species name. The search was also limited to only those proteins that have been identified due to experimental observation of the protein itself or its mRNA transcript.

For each protein the weight fraction of each amino acid was computed and the PDCAAS value derived. The proteins were also evaluated for similarity to EAA/NEAA (Whey) target amino acid profiles of 70/30 and 60/40 using a Euclidean distance metric as described herein.

Additionally, fragments of each protein were identified and analyzed to compute the weight fraction of each amino acid and the PDCAAS value for the fragment. A deterministic, hierarchical search strategy employing tiered fragmentation frequencies and PDCAAS cutoffs was used to identify sets of 1,000 fragments from the protein database having the highest PDCAAS value or similarity to a chosen EAA/NEAA (Whey) target amino acid profile. While this approach could be applied to analyze every fragment of every possible size within every protein in the database the search was truncated for the purpose of the examples presented herein.

Example 2

Naturally Occurring Protein Fragments Ranked by PDCAAS Score

In this example the PDCAAS Score was used to rank protein fragments identified in the SwissProt database using the approach of Example 1. The 1000 fragments from the analysis with the highest PDCAAS scores were identified and are included in the Sequence Listing. The 100 fragments from the analysis with the highest PDCAAS scores were identified and are presented in Table 6. In Table 6A the proteins the fragments are derived from are identified by UniProtID number in the first column of the table. The fragment itself is further identified by the amino acids positions in the protein that appear at the N and C termini of the fragment (second column). For example (12:145) indicates that the N-terminus of the fragment is amino acid 12 of the protein and the C-terminus of the fragment is at amino acid 145 of the protein. The third column indicates whether the fragment contains every essential amino acid (1) or not (0). The fourth and fifth columns present the weight fraction of essential amino acids (EAA), and the total of non-essential and conditionally-essential amino acids (i.e., including C and Y) (NEAA+CEAA), respectively. The sixth column presents the PDCAAS score for each fragment. For the set of proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated and are presented in Table 6B.

FIGS. 1-4 present an analysis of the essential amino acid content of four of the identified fragments that have among the highest PCDAAS scores.

The essential amino acid content of the polypeptide fragment from amino acid 51 to amino acid 75 of the *Schizosaccharomyces pombe* ENTH domain-containing protein C19F8.03c protein (UniProt O60167) (SEQ ID NO: 415) is analyzed in FIG. 1. That fragment has a PCDAAS value of 2.46. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein.

Figure 2:
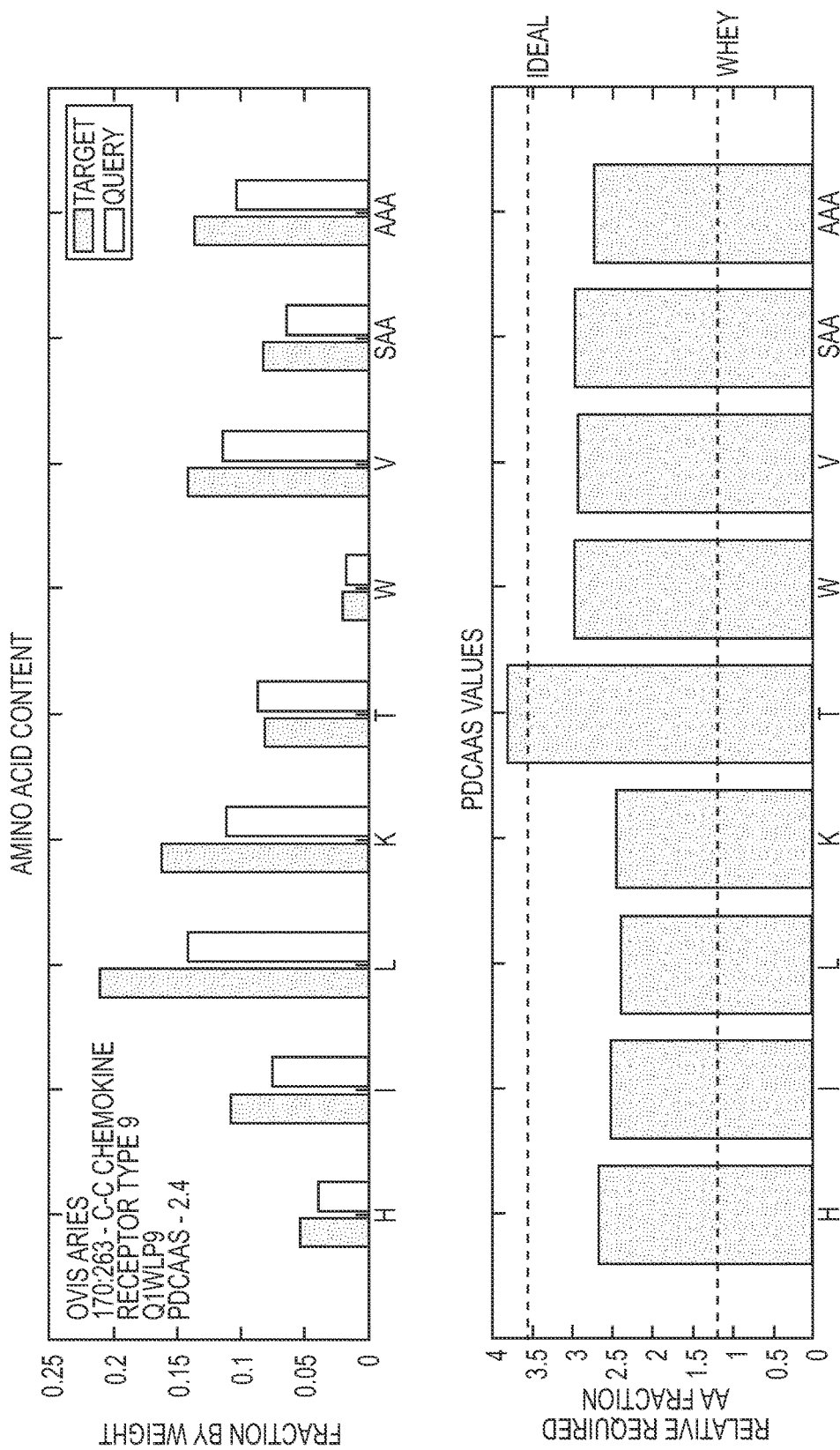
FIG. 2 shows the essential amino acid content of the polypeptide fragment from amino acid 170 to amino acid 263 of the *Ovis aries* C—C chemokine receptor 9 protein (UniProt Q1WLP9) (SEQ ID NO: 2016), which has a PDCAAS score of 2.4. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

The essential amino acid content of the polypeptide fragment from amino acid 170 to amino acid 263 (SEQ ID NO: 2016) of the *Ovis aries* C—C chemokine receptor 9 protein (UniProt Q1WLP9) is presented in FIG. 2. That fragment has a PCDAAS value of 2.41. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein.

Figure 3:
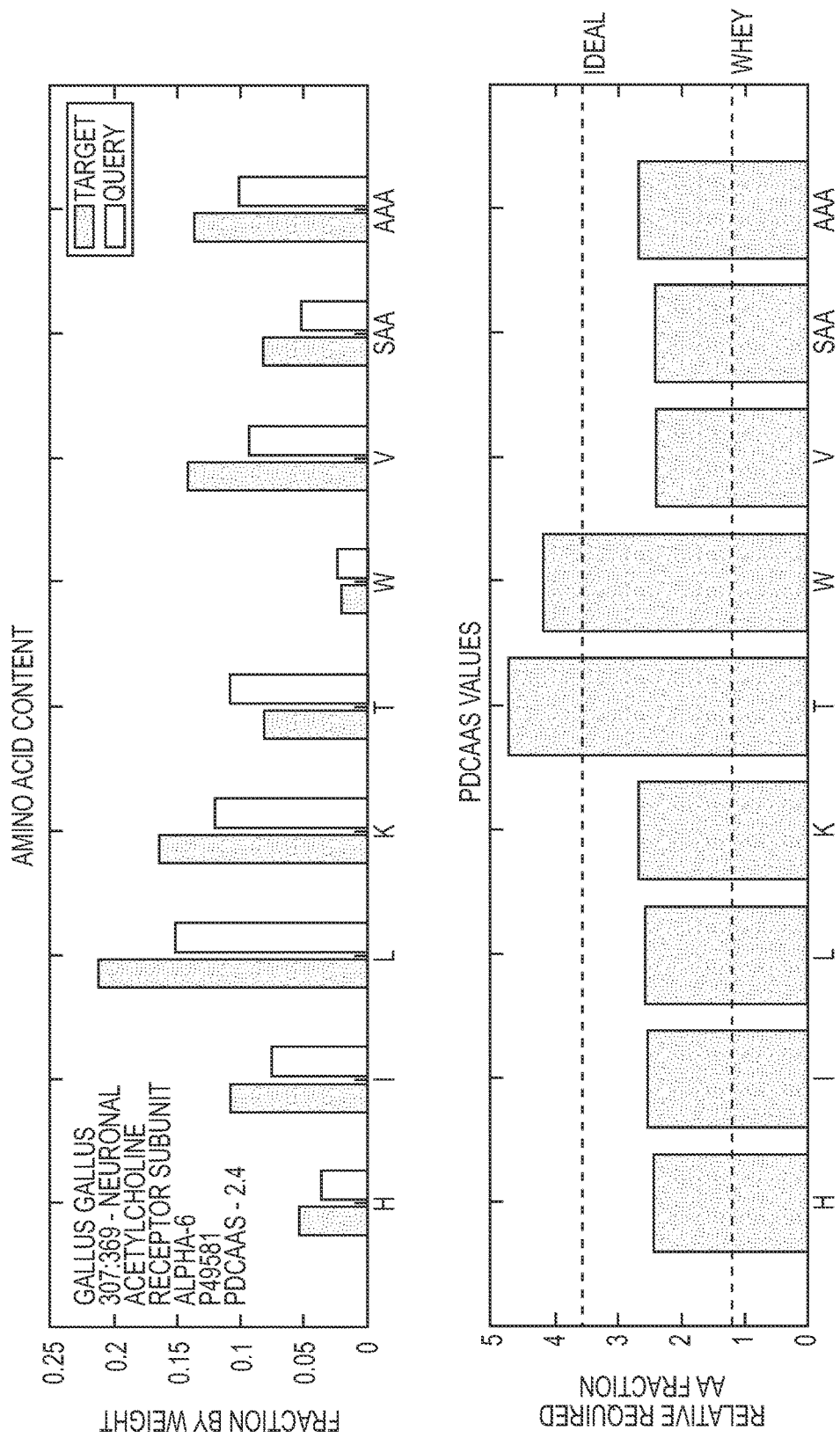
FIG. 3 shows the essential amino acid content of the polypeptide fragment from amino acid 307 to amino acid 369 of the *Gallus gallus* neuronal acetylcholine receptor subunit alpha-6 protein (UniProt P49581) (SEQ ID NO: 1366), which has a PDCAAS score of 2.4. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

The essential amino acid content of the polypeptide fragment from amino acid 307 to amino acid 369 of the *Gallus gallus* neuronal acetylcholine receptor subunit alpha-6 protein (UniProt P49581) (SEQ ID NO: 1366) is presented in FIG. 3. That fragment has a PCDAAS value of 2.40. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein.

Figure 4:
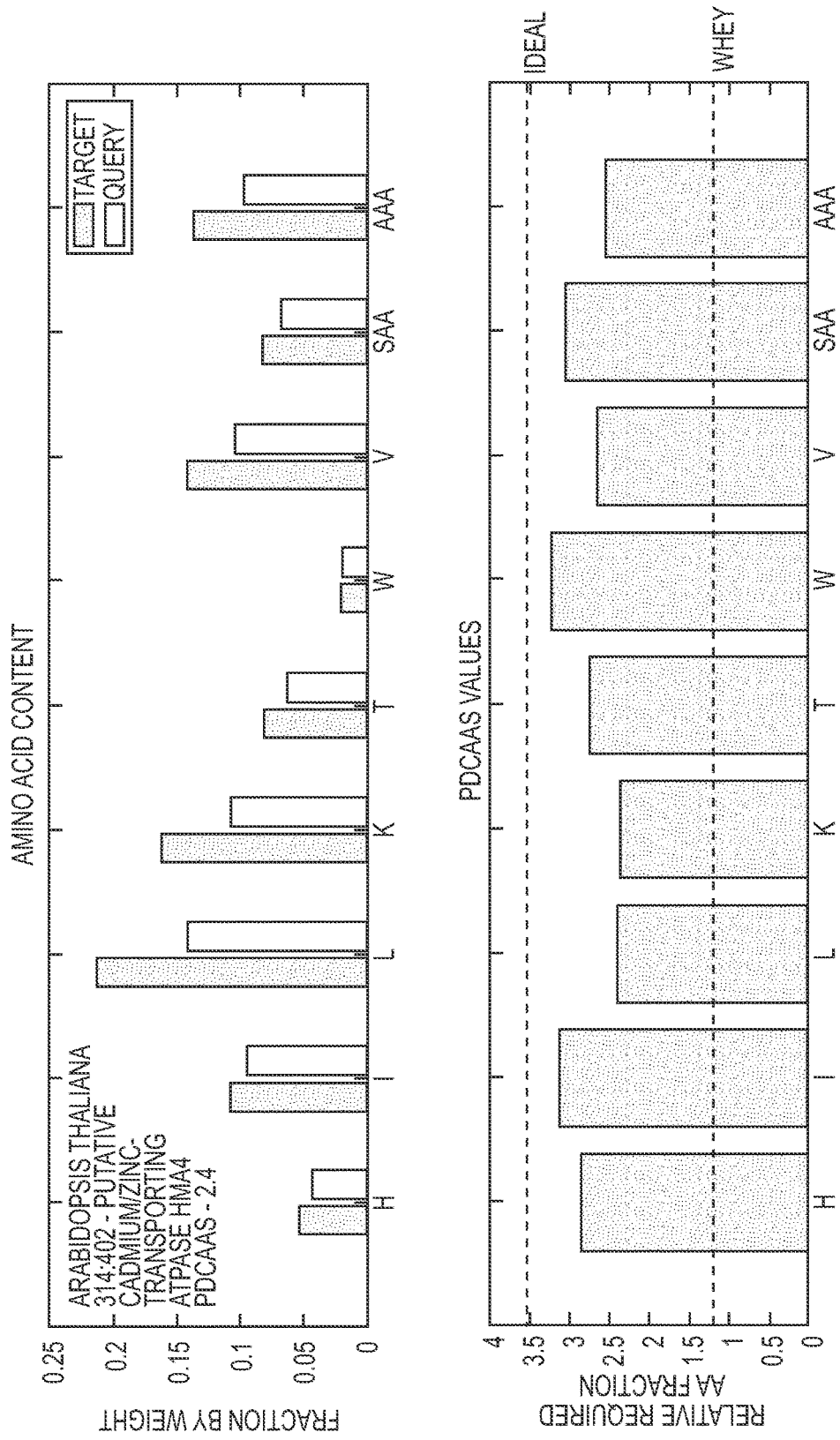
FIG. 4 shows the essential amino acid content of the polypeptide fragment from amino acid 314 to amino acid 402 of the *Arabidopsis thaliana* putative cadmium/zinc-transporting ATPase HMA4 protein (UniProt O64474) (SEQ ID NO: 421), which has a PDCAAS score of 2.4. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

The essential amino acid content of the polypeptide fragment from amino acid 314 to amino acid 402 of the *Arabidopsis thaliana* putative cadmium/zinc-transporting ATPase HMA4 protein (UniProt O64474) (SEQ ID NO: 421) is presented in FIG. 4. That fragment has a PCDAAS value of 2.39. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein. The PCDAAS scores of the set of 1000 fragments range from 2.61 to 1.93

TABLE 6A

| SeqIDNo | UniProtID | Fragment Ends | EAA Complete | [EAA] | [NEAA] | PDCAAS |
|---|---|---|---|---|---|---|
| 415 | O60167 | 51:75 | 1 | 0.75 | 0.25 | 2.46 |
| 2016 | Q1WLP9 | 170:263 | 1 | 0.67 | 0.33 | 2.41 |
| 2003 | Q1LZF8 | 292:355 | 1 | 0.69 | 0.31 | 2.41 |
| 1366 | P49581 | 307:369 | 1 | 0.75 | 0.25 | 2.40 |
| 421 | O64474 | 314:402 | 1 | 0.63 | 0.37 | 2.39 |
| 4200 | Q9SZW4 | 319:392 | 0 | 0.67 | 0.33 | 2.38 |
| 4104 | Q9SA37 | 379:420 | 1 | 0.73 | 0.27 | 2.38 |
| 3975 | Q9M008 | 219:281 | 1 | 0.68 | 0.32 | 2.36 |
| 1822 | Q08213 | 177:230 | 1 | 0.65 | 0.35 | 2.36 |
| 4109 | Q9SAK8 | 338:405 | 1 | 0.72 | 0.28 | 2.32 |
| 222 | O13712 | 665:758 | 1 | 0.64 | 0.36 | 2.31 |
| 4334 | Q9Y704 | 1186:1249 | 1 | 0.81 | 0.19 | 2.31 |
| 3984 | Q9M175 | 380:406 | 1 | 0.78 | 0.22 | 2.31 |
| 666 | P05363 | 246:272 | 1 | 0.81 | 0.19 | 2.30 |
| 4012 | Q9N1R5 | 87:140 | 1 | 0.71 | 0.29 | 2.30 |
| 3513 | Q92182 | 3:45 | 1 | 0.66 | 0.34 | 2.29 |
| 2715 | Q5ZLF4 | 71:119 | 1 | 0.75 | 0.25 | 2.27 |
| 3793 | Q9FFT9 | 289:345 | 1 | 0.71 | 0.29 | 2.27 |
| 3788 | Q9FE38 | 458:555 | 1 | 0.65 | 0.35 | 2.27 |
| 1198 | P38803 | 135:177 | 1 | 0.64 | 0.36 | 2.27 |
| 4025 | Q9P7K5 | 750:815 | 1 | 0.69 | 0.31 | 2.27 |
| 2565 | Q5N749 | 423:451 | 0 | 0.64 | 0.36 | 2.26 |
| 3967 | Q9LYG9 | 209:381 | 1 | 0.68 | 0.32 | 2.26 |

TABLE 6A-continued

| SeqIDNo | UniProtID | Fragment Ends | EAA Complete | [EAA] | [NEAA] | PDCAAS |
|---|---|---|---|---|---|---|
| 3173 | Q84YJ9 | 155:213 | 1 | 0.68 | 0.32 | 2.26 |
| 1323 | P47077 | 526:582 | 1 | 0.64 | 0.36 | 2.26 |
| 3855 | Q9GL50 | 119:161 | 1 | 0.68 | 0.32 | 2.26 |
| 3361 | Q8LES0 | 199:257 | 1 | 0.64 | 0.36 | 2.26 |
| 2118 | Q2HJ17 | 188:220 | 1 | 0.78 | 0.22 | 2.25 |
| 2062 | Q28044 | 270:299 | 1 | 0.85 | 0.15 | 2.23 |
| 3300 | Q8GXD6 | 257:300 | 1 | 0.72 | 0.28 | 2.23 |
| 3677 | Q9CA25 | 249:277 | 1 | 0.73 | 0.27 | 2.23 |
| 274 | O23413 | 50:162 | 1 | 0.63 | 0.37 | 2.23 |
| 88 | A6QNL7 | 225:289 | 1 | 0.68 | 0.32 | 2.23 |
| 3163 | Q84M97 | 167:299 | 1 | 0.75 | 0.25 | 2.22 |
| 2063 | Q28132 | 2:67 | 1 | 0.61 | 0.39 | 2.22 |
| 2065 | Q28132-2 | 2:67 | 1 | 0.61 | 0.39 | 2.22 |
| 1110 | P32584 | 109:169 | 1 | 0.68 | 0.32 | 2.22 |
| 494 | O81770 | 267:295 | 0 | 0.80 | 0.20 | 2.22 |
| 496 | O81770-2 | 267:295 | 0 | 0.80 | 0.20 | 2.22 |
| 3844 | Q9FZL4 | 264:292 | 0 | 0.80 | 0.20 | 2.22 |
| 194 | O04722 | 302:347 | 1 | 0.70 | 0.30 | 2.22 |
| 762 | P0CW78 | 328:423 | 1 | 0.66 | 0.34 | 2.21 |
| 185 | O02697 | 195:223 | 1 | 0.63 | 0.37 | 2.21 |
| 3589 | Q95M19 | 2:67 | 1 | 0.60 | 0.40 | 2.20 |
| 2466 | Q58CW4 | 217:283 | 1 | 0.66 | 0.34 | 2.20 |
| 3806 | Q9FIJ0 | 384:478 | 1 | 0.61 | 0.39 | 2.20 |
| 1628 | P79368 | 2:67 | 1 | 0.61 | 0.39 | 2.20 |
| 1182 | P38221 | 184:252 | 1 | 0.73 | 0.27 | 2.20 |
| 3595 | Q95N03 | 166:288 | 1 | 0.64 | 0.36 | 2.19 |
| 2185 | Q39079 | 328:359 | 1 | 0.70 | 0.30 | 2.19 |
| 3590 | Q95MD2 | 41:70 | 0 | 0.62 | 0.38 | 2.19 |
| 1953 | Q12276 | 525:592 | 1 | 0.67 | 0.33 | 2.19 |
| 1625 | P79222-2 | 323:389 | 1 | 0.65 | 0.35 | 2.19 |
| 2131 | Q2KTE1 | 218:251 | 1 | 0.79 | 0.21 | 2.18 |
| 31 | A2PZE5 | 102:164 | 1 | 0.65 | 0.35 | 2.18 |
| 4162 | Q9SUP0 | 14:154 | 1 | 0.65 | 0.35 | 2.18 |
| 3981 | Q9M173 | 347:405 | 1 | 0.65 | 0.35 | 2.18 |
| 1688 | P92949 | 91:150 | 1 | 0.69 | 0.31 | 2.18 |
| 1944 | Q10M80 | 109:181 | 1 | 0.75 | 0.25 | 2.18 |
| 263 | O22757 | 52:132 | 1 | 0.67 | 0.33 | 2.18 |
| 3450 | Q8VYC2 | 329:358 | 1 | 0.66 | 0.34 | 2.18 |
| 1781 | Q05005 | 63:109 | 1 | 0.78 | 0.22 | 2.17 |
| 3302 | Q8GXR2 | 243:357 | 1 | 0.69 | 0.31 | 2.17 |
| 3445 | Q8VXB5 | 123:205 | 1 | 0.62 | 0.38 | 2.17 |
| 1187 | P38250 | 262:327 | 1 | 0.65 | 0.35 | 2.17 |
| 997 | P25360 | 441:511 | 1 | 0.67 | 0.33 | 2.17 |
| 4212 | Q9TTU3 | 158:231 | 0 | 0.60 | 0.40 | 2.17 |
| 342 | O48901 | 982:1011 | 0 | 0.58 | 0.42 | 2.17 |
| 1909 | Q0WPQ2 | 73:175 | 1 | 0.73 | 0.27 | 2.17 |
| 1230 | P40456 | 607:652 | 1 | 0.78 | 0.22 | 2.16 |
| 2979 | Q6R8G0 | 623:725 | 1 | 0.66 | 0.34 | 2.16 |
| 3835 | Q9FUG4 | 412:474 | 1 | 0.61 | 0.39 | 2.16 |
| 269 | O23278 | 382:454 | 1 | 0.67 | 0.33 | 2.16 |
| 1204 | P38960 | 412:470 | 1 | 0.61 | 0.39 | 2.16 |
| 4194 | Q9SYZ7 | 199:229 | 0 | 0.75 | 0.25 | 2.16 |
| 1959 | Q12520 | 46:149 | 1 | 0.63 | 0.37 | 2.15 |
| 2318 | Q41342 | 59:140 | 1 | 0.71 | 0.29 | 2.15 |
| 4107 | Q9SAH8 | 407:438 | 1 | 0.75 | 0.25 | 2.14 |
| 486 | O81016 | 482:572 | 1 | 0.68 | 0.32 | 2.14 |
| 1207 | P39073 | 299:329 | 1 | 0.67 | 0.33 | 2.14 |
| 1192 | P38352 | 488:534 | 0 | 0.60 | 0.40 | 2.14 |
| 798 | P12394 | 294:339 | 1 | 0.64 | 0.36 | 2.14 |
| 4174 | Q9SW17 | 439:499 | 1 | 0.72 | 0.28 | 2.14 |
| 1166 | P36512 | 483:528 | 0 | 0.60 | 0.40 | 2.14 |
| 538 | O94461 | 112:172 | 1 | 0.67 | 0.33 | 2.14 |
| 3926 | Q9LK39 | 383:452 | 1 | 0.63 | 0.37 | 2.14 |
| 4179 | Q9SWS1 | 50:105 | 1 | 0.73 | 0.27 | 2.13 |
| 2111 | Q29RU8 | 508:600 | 1 | 0.62 | 0.38 | 2.13 |
| 2175 | Q38707 | 142:215 | 1 | 0.57 | 0.43 | 2.13 |
| 1185 | P38242 | 111:180 | 1 | 0.64 | 0.36 | 2.13 |
| 2079 | Q28997 | 133:178 | 1 | 0.68 | 0.32 | 2.13 |
| 4342 | Q9Y802 | 499:614 | 1 | 0.61 | 0.39 | 2.13 |
| 3882 | Q9IAL7 | 5:67 | 1 | 0.62 | 0.38 | 2.13 |
| 3884 | Q9IAL7-2 | 5:67 | 1 | 0.62 | 0.38 | 2.13 |
| 3606 | Q96323 | 233:296 | 1 | 0.61 | 0.39 | 2.13 |
| 867 | P16661 | 71:125 | 1 | 0.68 | 0.32 | 2.13 |
| 3372 | Q8LPL8 | 459:492 | 0 | 0.73 | 0.27 | 2.13 |
| 2171 | Q32PJ3 | 129:314 | 1 | 0.60 | 0.40 | 2.13 |

TABLE 6A-continued

| SeqIDNo | UniProtID | Fragment Ends | EAA Complete | [EAA] | [NEAA] | PDCAAS |
|---|---|---|---|---|---|---|
| 3974 | Q9LZR3 | 418:463 | 1 | 0.69 | 0.31 | 2.12 |
| 3867 | Q9HDU1 | 160:204 | 1 | 0.72 | 0.28 | 2.12 |

TABLE 6B

| Seq ID No | SolvScore | AggScore | Allergenicity | Toxicity | Antinutricity | Human Homology |
|---|---|---|---|---|---|---|
| 415 | −19.86 | 1.03 | 0.14 | 0.42 | 0.38 | 0.46 |
| 2016 | −13.06 | 1.31 | 0.29 | 0.22 | 0.25 | 0.87 |
| 2003 | −11.83 | 1.11 | 0.25 | 0.00 | 0.00 | 0.91 |
| 1366 | −14.98 | 1.13 | 0.20 | 0.00 | 0.00 | 0.76 |
| 421 | −11.24 | 1.23 | 0.29 | 0.00 | 0.29 | 0.35 |
| 4200 | −11.84 | 1.25 | 0.24 | 0.00 | 0.25 | 0.42 |
| 4104 | −14.53 | 1.17 | 0.15 | 0.26 | 0.19 | 0.29 |
| 3975 | −13.90 | 1.08 | 0.21 | 0.31 | 0.29 | 0.00 |
| 1822 | −20.36 | 0.77 | 0.23 | 0.31 | 0.22 | 0.33 |
| 4109 | −13.02 | 1.12 | 0.22 | 0.25 | 0.22 | 0.30 |
| 222 | −14.59 | 0.78 | 0.28 | 0.00 | 0.25 | 0.27 |
| 4334 | −9.87 | 1.23 | 0.24 | 0.00 | 0.00 | 0.28 |
| 3984 | −13.17 | 0.75 | 0.12 | 0.00 | 0.37 | 0.41 |
| 666 | −9.89 | 1.63 | 0.12 | 0.37 | 0.29 | 0.96 |
| 4012 | −12.94 | 1.24 | 0.19 | 0.31 | 0.00 | 0.96 |
| 3513 | −14.66 | 1.15 | 0.18 | 0.29 | 0.29 | 0.41 |
| 2715 | −10.97 | 1.06 | 0.20 | 0.32 | 0.31 | 0.94 |
| 3793 | −17.61 | 0.71 | 0.20 | 0.24 | 0.00 | 0.32 |
| 3788 | −11.14 | 0.90 | 0.30 | 0.30 | 0.28 | 0.25 |
| 1198 | −16.72 | 0.59 | 0.16 | 0.35 | 0.33 | 0.36 |
| 4025 | −14.82 | 0.84 | 0.23 | 0.24 | 0.25 | 0.00 |
| 2565 | −15.51 | 0.87 | 0.14 | 0.34 | 0.34 | 0.45 |
| 3967 | −16.45 | 0.90 | 0.30 | 0.21 | 0.23 | 0.22 |
| 3173 | −14.87 | 0.74 | 0.18 | 0.27 | 0.26 | 0.32 |
| 1323 | −19.83 | 0.42 | 0.19 | 0.28 | 0.32 | 0.33 |
| 3855 | −14.21 | 1.06 | 0.21 | 0.28 | 0.30 | 0.95 |
| 3361 | −12.31 | 0.91 | 0.23 | 0.24 | 0.25 | 0.34 |
| 2118 | −8.63 | 1.61 | 0.15 | 0.33 | 0.27 | 0.88 |
| 2062 | −8.99 | 1.50 | 0.13 | 0.40 | 0.37 | 0.97 |
| 3300 | −14.39 | 1.03 | 0.16 | 0.00 | 0.31 | 0.41 |
| 3677 | −12.31 | 1.21 | 0.13 | 0.00 | 0.31 | 0.41 |
| 274 | −11.52 | 1.07 | 0.30 | 0.22 | 0.23 | 0.22 |
| 88 | −15.67 | 1.14 | 0.22 | 0.26 | 0.28 | 0.82 |
| 3163 | −16.23 | 1.15 | 0.28 | 0.22 | 0.00 | 0.00 |
| 2063 | −16.26 | 0.62 | 0.24 | 0.24 | 0.22 | 0.91 |
| 2065 | −16.26 | 0.62 | 0.24 | 0.24 | 0.22 | 0.91 |
| 1110 | −13.94 | 0.81 | 0.19 | 0.25 | 0.28 | 0.39 |
| 494 | −15.68 | 0.63 | 0.14 | 0.41 | 0.32 | 0.40 |
| 496 | −15.68 | 0.63 | 0.14 | 0.41 | 0.32 | 0.40 |
| 3844 | −15.68 | 0.63 | 0.14 | 0.41 | 0.32 | 0.40 |
| 194 | −14.55 | 1.03 | 0.21 | 0.00 | 0.33 | 0.35 |
| 762 | −13.63 | 0.95 | 0.29 | 0.00 | 0.25 | 0.38 |
| 185 | −12.75 | 0.66 | 0.14 | 0.38 | 0.34 | 0.90 |
| 3589 | −17.24 | 0.60 | 0.23 | 0.24 | 0.25 | 0.91 |
| 2466 | −14.15 | 1.18 | 0.22 | 0.00 | 0.00 | 0.84 |
| 3806 | −12.16 | 0.94 | 0.28 | 0.00 | 0.23 | 0.36 |
| 1628 | −17.23 | 0.60 | 0.23 | 0.24 | 0.22 | 0.92 |
| 1182 | −10.60 | 1.28 | 0.24 | 0.26 | 0.28 | 0.52 |
| 3595 | −16.40 | 1.10 | 0.29 | 0.24 | 0.21 | 0.74 |
| 2185 | −15.32 | 0.88 | 0.14 | 0.00 | 0.41 | 0.38 |
| 3590 | −17.01 | 0.47 | 0.12 | 0.35 | 0.42 | 0.97 |
| 1953 | −15.64 | 0.87 | 0.23 | 0.24 | 0.28 | 0.28 |
| 1625 | −15.74 | 0.72 | 0.25 | 0.25 | 0.25 | 0.79 |
| 2131 | −12.52 | 1.47 | 0.12 | 0.38 | 0.24 | 1.00 |
| 31 | −9.20 | 1.02 | 0.21 | 0.31 | 0.29 | 0.33 |
| 4162 | −13.57 | 1.11 | 0.32 | 0.25 | 0.23 | 0.00 |
| 3981 | −9.72 | 0.89 | 0.21 | 0.00 | 0.00 | 0.38 |
| 1688 | −16.78 | 1.02 | 0.25 | 0.27 | 0.30 | 0.28 |
| 1944 | −13.57 | 0.92 | 0.27 | 0.00 | 0.00 | 0.35 |
| 263 | −15.59 | 1.06 | 0.26 | 0.33 | 0.22 | 0.29 |
| 3450 | −17.72 | 0.65 | 0.15 | 0.29 | 0.37 | 0.37 |
| 1781 | −13.94 | 1.32 | 0.16 | 0.00 | 0.31 | 0.83 |
| 3302 | −17.35 | 0.88 | 0.31 | 0.00 | 0.00 | 0.33 |
| 3445 | −17.33 | 1.18 | 0.25 | 0.00 | 0.24 | 0.24 |
| 1187 | −12.62 | 1.04 | 0.22 | 0.27 | 0.27 | 0.28 |
| 997 | −15.05 | 1.12 | 0.25 | 0.24 | 0.00 | 0.28 |
| 4212 | −11.70 | 0.99 | 0.27 | 0.31 | 0.25 | 0.99 |
| 342 | −16.97 | 0.64 | 0.13 | 0.39 | 0.38 | 0.40 |
| 1909 | −14.17 | 1.10 | 0.29 | 0.00 | 0.22 | 0.24 |
| 1230 | −11.20 | 1.06 | 0.20 | 0.28 | 0.30 | 0.35 |
| 2979 | −15.58 | 0.96 | 0.28 | 0.00 | 0.22 | 0.28 |
| 3835 | −18.62 | 0.61 | 0.23 | 0.28 | 0.25 | 0.71 |
| 269 | −21.06 | 0.75 | 0.22 | 0.00 | 0.26 | 0.00 |
| 1204 | −19.20 | 0.44 | 0.20 | 0.24 | 0.30 | 0.29 |
| 4194 | −16.03 | 1.31 | 0.15 | 0.32 | 0.32 | 0.42 |
| 1959 | −12.87 | 0.93 | 0.29 | 0.00 | 0.26 | 0.29 |
| 2318 | −12.83 | 1.09 | 0.26 | 0.26 | 0.26 | 0.27 |
| 4107 | −8.94 | 1.07 | 0.13 | 0.41 | 0.38 | 0.41 |
| 486 | −13.12 | 0.98 | 0.27 | 0.00 | 0.28 | 0.27 |
| 1207 | −16.58 | 0.67 | 0.14 | 0.28 | 0.00 | 0.52 |
| 1192 | −14.46 | 0.68 | 0.19 | 0.31 | 0.31 | 0.29 |
| 798 | −19.06 | 0.68 | 0.17 | 0.00 | 0.25 | 0.63 |
| 4174 | −13.67 | 1.08 | 0.23 | 0.00 | 0.00 | 0.34 |
| 1166 | −13.75 | 1.21 | 0.18 | 0.29 | 0.35 | 0.63 |
| 538 | −21.74 | 0.58 | 0.22 | 0.26 | 0.00 | 0.31 |
| 3926 | −17.64 | 0.77 | 0.24 | 0.25 | 0.29 | 0.00 |
| 4179 | −9.92 | 1.22 | 0.22 | 0.20 | 0.28 | 0.42 |
| 2111 | −15.67 | 0.74 | 0.26 | 0.00 | 0.27 | 0.80 |
| 2175 | −13.73 | 0.75 | 0.36 | 0.00 | 0.29 | 0.33 |
| 1185 | −14.52 | 0.87 | 0.21 | 0.30 | 0.28 | 0.31 |
| 2079 | −10.56 | 1.13 | 0.17 | 0.24 | 0.30 | 0.85 |
| 4342 | −17.56 | 0.53 | 0.28 | 0.26 | 0.26 | 0.28 |
| 3882 | −18.45 | 0.86 | 0.22 | 0.00 | 0.24 | 0.56 |
| 3884 | −18.45 | 0.86 | 0.22 | 0.00 | 0.24 | 0.56 |
| 3606 | −17.83 | 0.53 | 0.21 | 0.26 | 0.29 | 0.00 |
| 867 | −15.72 | 0.80 | 0.22 | 0.24 | 0.33 | 0.31 |
| 3372 | −8.74 | 1.51 | 0.16 | 0.26 | 0.32 | 0.32 |
| 2171 | −17.28 | 0.64 | 0.29 | 0.00 | 0.22 | 0.88 |
| 3974 | −19.93 | 0.71 | 0.17 | 0.31 | 0.00 | 0.30 |
| 3867 | −11.83 | 1.43 | 0.16 | 0.35 | 0.29 | 0.30 |

Example 3

Protein Fragments Ranked by Euclidian Distance from a 60/40 EAA/NEAA (Whey) Profile or a 70/30 EAA/NEAA (Whey) Profile In this example the Euclidian distance from a 60/40 EAA/NEAA (Whey) target amino acid profile or from a 70/30 EAA/NEAA (Whey) target amino acid profile was used to rank protein fragments identified in the SwissProt database using the approach of Example 1. After protein fragments were identified in this way the PDCAAS of each fragment was also determined. The 1000 fragments from the analysis with the smallest Euclidian distance from a 70/30 EAA/NEAA (Whey) target amino acid profile are presented in the Sequence Listing. The 100 fragments from the analysis with the smallest Euclidian distance from a 70/30 EAA/NEAA (Whey) target amino acid profile are presented in Table 7. In Table 7A the proteins the fragments are derived from are identified by UniProtID number in the first column of the table. The fragment itself is further identified by the amino acids positions in the protein that appear at the N and C termini of the fragment (second column). For example (12:145) indicates that the N-terminus of the fragment is amino acid 12 of the protein and the C-terminus of the fragment is at amino acid 145 of the protein. The third column indicates whether the fragment contains every essential amino acid (1) or not (0). The fourth and fifth columns present the weight fraction of essential amino acids (EAA), and the total of non-essential and conditionally-essential amino acids (i.e., including C and Y) (NEAA+ CEAA), respectively. The sixth column presents the PDCAAS score for each fragment. For the set of proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated and are presented in Table 7B.

The 1000 fragments from the analysis with the smallest Euclidian distance from a 60/40 EAA/NEAA (Whey) target amino acid profile were identified and are included in the Sequence Listing. The 100 fragments from the analysis with the smallest Euclidian distance from a 60/40 EAA/NEAA (Whey) target amino acid profile are presented in Table 8. In each table the fragments were first ranked by PDCAAS score and then ranked by Euclidian distance from the target profile. In Table 8A the proteins the fragments are derived from are identified by UniProID number in the first column of the table. The fragment itself is further identified by the amino acids positions in the protein that appear at the N and C termini of the fragment (second column). For example (12:145) indicates that the N-terminus of the fragment is amino acid 12 of the protein and the C-terminus of the fragment is at amino acid 145 of the protein. The third column indicates whether the fragment contains every essential amino acid (1) or not (0). The fourth and fifth columns present the weight fraction of essential amino acids (EAA), and the total of non-essential and conditionally-essential amino acids (i.e., including C and Y) (NEAA+ CEAA), respectively. The sixth column presents the PDCAAS score for each fragment. The seventh column presents the distance from the target distribution for each fragment. For the set of proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated and are presented in Table 8B.

The Euclidian distance from a 70/30 EAA/NEAA (Whey) target amino acid profile of the set of 1000 fragments ranges from 0.0458 to 0.1524. The Euclidian distance from a 60/40 EAA/NEAA (Whey) target amino acid profile of the set of 1000 fragments ranges from 0.0380 to 0.117.

TABLE 7A

| SeqIDNo | UniProtID | Fragment Ends | EAA Complete | [EAA] | [NEAA] | PDCAAS | Dist. Target |
|---|---|---|---|---|---|---|---|
| 4199 | Q9SZW4 | 277:380 | 1 | 0.58 | 0.42 | 2.20 | 0.0459 |
| 2017 | Q1WLP9 | 170:279 | 1 | 0.65 | 0.35 | 2.11 | 0.0603 |
| 3836 | Q9FUG4 | 412:476 | 1 | 0.59 | 0.41 | 2.10 | 0.0612 |
| 4343 | Q9Y802 | 504:615 | 1 | 0.62 | 0.38 | 2.08 | 0.0754 |
| 4163 | Q9SUP0 | 4:157 | 1 | 0.65 | 0.35 | 2.07 | 0.0779 |
| 87 | A6QNL7 | 221:293 | 1 | 0.65 | 0.35 | 2.06 | 0.1091 |
| 4401 | Q9ZVE0 | 63:170 | 1 | 0.56 | 0.44 | 2.01 | 0.0578 |
| 195 | O04722 | 303:355 | 1 | 0.67 | 0.33 | 1.98 | 0.0616 |
| 1274 | P43544 | 6:118 | 1 | 0.53 | 0.47 | 1.98 | 0.0622 |
| 2467 | Q58CW4 | 227:284 | 1 | 0.64 | 0.36 | 1.97 | 0.0630 |
| 268 | O23278 | 380:461 | 1 | 0.64 | 0.36 | 1.96 | 0.0651 |
| 2799 | Q65AC2 | 315:513 | 1 | 0.60 | 0.40 | 1.96 | 0.0660 |
| 1433 | P53666 | 343:479 | 1 | 0.59 | 0.41 | 1.96 | 0.0693 |
| 1837 | Q08960 | 543:629 | 1 | 0.56 | 0.44 | 1.99 | 0.0694 |
| 4238 | Q9UTL9 | 261:383 | 1 | 0.59 | 0.41 | 2.00 | 0.0697 |
| 2202 | Q3E7D1 | 154:352 | 1 | 0.56 | 0.44 | 1.95 | 0.0703 |
| 1919 | Q0WVW7 | 702:769 | 1 | 0.58 | 0.42 | 2.04 | 0.0713 |
| 3911 | Q9LD37 | 224:300 | 1 | 0.62 | 0.38 | 1.96 | 0.0715 |
| 3569 | Q94LW6 | 205:361 | 1 | 0.60 | 0.40 | 1.99 | 0.0717 |
| 89 | A6QQL0 | 269:436 | 1 | 0.59 | 0.41 | 1.96 | 0.0720 |
| 4024 | Q9P7D7 | 190:372 | 1 | 0.52 | 0.48 | 1.98 | 0.0733 |
| 2697 | Q5ZIL2 | 19:105 | 1 | 0.56 | 0.44 | 1.96 | 0.0761 |
| 3825 | Q9FLT4 | 306:360 | 1 | 0.69 | 0.31 | 2.04 | 0.0764 |
| 4178 | Q9SWS1 | 22:81 | 1 | 0.63 | 0.37 | 1.99 | 0.0765 |
| 2156 | Q32L23 | 343:479 | 1 | 0.58 | 0.42 | 1.96 | 0.0766 |
| 1867 | Q09889 | 197:311 | 1 | 0.53 | 0.47 | 1.96 | 0.0774 |
| 1234 | P40527 | 728:868 | 1 | 0.53 | 0.47 | 1.95 | 0.0775 |
| 2468 | Q58D00 | 227:349 | 0 | 0.53 | 0.47 | 2.01 | 0.0781 |
| 3566 | Q94KB7 | 394:462 | 1 | 0.61 | 0.39 | 1.96 | 0.0783 |
| 3514 | Q92182 | 3:50 | 1 | 0.63 | 0.37 | 2.05 | 0.0790 |
| 4173 | Q9SW17 | 332:483 | 1 | 0.61 | 0.39 | 1.97 | 0.0800 |
| 709 | P08417 | 357:481 | 1 | 0.54 | 0.46 | 1.97 | 0.0807 |
| 3956 | Q9LVQ5 | 53:111 | 1 | 0.63 | 0.37 | 1.97 | 0.0812 |
| 2110 | Q29RU8 | 504:605 | 1 | 0.59 | 0.41 | 1.95 | 0.0812 |
| 54 | A4IFA3 | 595:712 | 1 | 0.56 | 0.44 | 2.00 | 0.0815 |
| 3925 | Q9LK39 | 366:485 | 1 | 0.57 | 0.43 | 1.97 | 0.0833 |
| 2910 | Q6LA56 | 26:154 | 1 | 0.58 | 0.42 | 2.04 | 0.0839 |
| 1111 | P32584 | 95:169 | 1 | 0.65 | 0.35 | 2.04 | 0.0846 |
| 1071 | P30620 | 434:546 | 1 | 0.59 | 0.41 | 2.03 | 0.0868 |
| 1689 | P93028 | 905:985 | 1 | 0.56 | 0.44 | 1.95 | 0.0880 |
| 469 | O77480 | 292:356 | 1 | 0.55 | 0.45 | 1.97 | 0.0881 |

TABLE 7A-continued

| SeqIDNo | UniProtID | Fragment Ends | EAA Complete | [EAA] | [NEAA] | PDCAAS | Dist. Target |
|---|---|---|---|---|---|---|---|
| 3976 | Q9M008 | 224:290 | 1 | 0.65 | 0.35 | 1.98 | 0.0912 |
| 1203 | P38960 | 408:472 | 1 | 0.57 | 0.43 | 1.96 | 0.0913 |
| 223 | O13712 | 677:807 | 1 | 0.59 | 0.41 | 2.00 | 0.0926 |
| 1441 | P53730 | 331:364 | 1 | 0.66 | 0.34 | 2.01 | 0.1053 |
| 1005 | P25847 | 46:133 | 1 | 0.55 | 0.45 | 1.86 | 0.0608 |
| 344 | O49160 | 246:319 | 1 | 0.62 | 0.38 | 1.85 | 0.0613 |
| 1832 | Q08905 | 454:639 | 1 | 0.54 | 0.46 | 1.86 | 0.0615 |
| 2525 | Q5F361 | 127:253 | 1 | 0.56 | 0.44 | 1.87 | 0.0632 |
| 4189 | Q9SY55 | 234:338 | 1 | 0.59 | 0.41 | 1.91 | 0.0636 |
| 3816 | Q9FKR3 | 144:245 | 1 | 0.59 | 0.41 | 1.85 | 0.0637 |
| 2108 | Q29RL1 | 292:396 | 1 | 0.63 | 0.37 | 1.89 | 0.0642 |
| 1159 | P36421 | 1:126 | 1 | 0.54 | 0.46 | 1.87 | 0.0651 |
| 534 | O94265 | 97:269 | 1 | 0.55 | 0.45 | 1.91 | 0.0670 |
| 3299 | Q8GXD6 | 255:338 | 1 | 0.60 | 0.40 | 1.94 | 0.0676 |
| 1325 | P47082 | 386:521 | 1 | 0.60 | 0.40 | 1.88 | 0.0682 |
| 1814 | Q07527 | 1305:1435 | 1 | 0.57 | 0.43 | 1.87 | 0.0687 |
| 3605 | Q96323 | 219:285 | 1 | 0.56 | 0.44 | 1.94 | 0.0688 |
| 4132 | Q9SJ73 | 323:417 | 1 | 0.60 | 0.40 | 1.93 | 0.0689 |
| 1776 | Q04658 | 238:369 | 1 | 0.56 | 0.44 | 1.90 | 0.0690 |
| 357 | O49621 | 14:205 | 1 | 0.62 | 0.38 | 1.91 | 0.0693 |
| 2702 | Q5ZKB7 | 194:377 | 1 | 0.54 | 0.46 | 1.92 | 0.0699 |
| 3962 | Q9LXW7 | 90:222 | 1 | 0.55 | 0.45 | 1.91 | 0.0700 |
| 3454 | Q8VZZ4 | 791:964 | 1 | 0.54 | 0.46 | 1.91 | 0.0701 |
| 3983 | Q9M175 | 261:435 | 1 | 0.59 | 0.41 | 1.86 | 0.0713 |
| 3591 | Q95MD2 | 9:94 | 1 | 0.58 | 0.42 | 1.88 | 0.0721 |
| 2101 | Q29449 | 706:835 | 1 | 0.52 | 0.48 | 1.94 | 0.0725 |
| 1213 | P39535 | 411:492 | 1 | 0.63 | 0.37 | 1.92 | 0.0728 |
| 1119 | P33333 | 28:198 | 1 | 0.59 | 0.41 | 1.85 | 0.0735 |
| 1197 | P38803 | 112:228 | 1 | 0.56 | 0.45 | 1.95 | 0.0739 |
| 2693 | Q5ZIE4 | 6:158 | 1 | 0.60 | 0.40 | 1.94 | 0.0741 |
| 484 | O80970 | 97:179 | 1 | 0.54 | 0.46 | 1.85 | 0.0743 |
| 866 | P16661 | 68:127 | 1 | 0.65 | 0.35 | 1.94 | 0.0746 |
| 475 | O80580 | 1:62 | 1 | 0.59 | 0.41 | 1.95 | 0.0746 |
| 4150 | Q9SNX8 | 43:233 | 1 | 0.54 | 0.46 | 1.87 | 0.0747 |
| 1882 | Q0P5F2 | 163:266 | 1 | 0.56 | 0.44 | 1.92 | 0.0752 |
| 1317 | P46682 | 341:510 | 1 | 0.58 | 0.42 | 1.91 | 0.0755 |
| 481 | O80961 | 10:89 | 1 | 0.69 | 0.31 | 1.93 | 0.0768 |
| 3807 | Q9FIJ0 | 396:498 | 1 | 0.55 | 0.45 | 1.87 | 0.0769 |
| 4026 | Q9P7K5 | 783:939 | 1 | 0.55 | 0.45 | 1.90 | 0.0770 |
| 120 | A8MQA3 | 127:245 | 1 | 0.53 | 0.47 | 1.95 | 0.0771 |
| 3594 | Q95N03 | 149:315 | 1 | 0.62 | 0.38 | 1.89 | 0.0771 |
| 3968 | Q9LYG9 | 240:435 | 1 | 0.60 | 0.40 | 1.88 | 0.0773 |
| 1773 | Q04602 | 660:742 | 1 | 0.63 | 0.37 | 1.90 | 0.0774 |
| 1335 | P48034 | 235:348 | 1 | 0.55 | 0.45 | 1.90 | 0.0776 |
| 3 | A0A1F3 | 256:332 | 1 | 0.57 | 0.43 | 1.89 | 0.0778 |
| 1054 | P29415 | 209:255 | 1 | 0.69 | 0.31 | 1.87 | 0.0779 |
| 2235 | Q3MHL4 | 271:420 | 1 | 0.56 | 0.44 | 1.90 | 0.0779 |
| 4011 | Q9N1R5 | 80:147 | 1 | 0.66 | 0.34 | 1.90 | 0.0786 |
| 2160 | Q32LB9 | 472:609 | 1 | 0.58 | 0.42 | 1.87 | 0.0789 |
| 2699 | Q5ZJ43 | 484:641 | 1 | 0.55 | 0.45 | 1.89 | 0.0797 |
| 1421 | P53119 | 712:792 | 1 | 0.58 | 0.42 | 1.88 | 0.0801 |
| 2978 | Q6R8G0 | 611:732 | 1 | 0.62 | 0.38 | 1.89 | 0.0809 |
| 4388 | Q9ZQR8-2 | 66:167 | 1 | 0.57 | 0.43 | 1.91 | 0.0810 |
| 62 | A5D7Q3 | 24:111 | 1 | 0.63 | 0.37 | 1.85 | 0.0812 |
| 251 | O18784-2 | 566:658 | 1 | 0.60 | 0.40 | 1.89 | 0.0815 |
| 3370 | Q8LPK2 | 288:379 | 1 | 0.59 | 0.41 | 1.85 | 0.0817 |
| 1229 | P40395 | 602:693 | 1 | 0.54 | 0.46 | 1.91 | 0.0821 |
| 4229 | Q9USR3 | 1131:1188 | 1 | 0.66 | 0.34 | 1.87 | 0.0823 |
| 3101 | Q7XRA1 | 177:332 | 1 | 0.52 | 0.48 | 1.86 | 0.0826 |

TABLE 7B

| Seq ID No | SolvScore | AggScore | Allerge- nicity | Toxic- ity | Anti- nutricity | Human Homo- logy |
|---|---|---|---|---|---|---|
| 4199 | −14.98 | 1.08 | 0.31 | 0.25 | 0.23 | 0.37 |
| 2017 | −12.50 | 1.23 | 0.29 | 0.00 | 0.26 | 0.87 |
| 3836 | −19.27 | 0.59 | 0.23 | 0.25 | 0.24 | 0.72 |
| 4343 | −18.71 | 0.56 | 0.28 | 0.28 | 0.25 | 0.29 |
| 4163 | −13.46 | 1.07 | 0.32 | 0.20 | 0.23 | 0.23 |
| 87 | −15.30 | 1.05 | 0.25 | 0.26 | 0.29 | 0.84 |
| 4401 | −19.75 | 0.65 | 0.29 | 0.24 | 0.00 | 0.45 |
| 195 | −16.02 | 0.90 | 0.18 | 0.00 | 0.29 | 0.35 |
| 1274 | −18.89 | 0.60 | 0.29 | 0.23 | 0.00 | 0.00 |
| 2467 | −17.40 | 1.05 | 0.20 | 0.29 | 0.00 | 0.84 |
| 268 | −19.84 | 0.69 | 0.25 | 0.00 | 0.26 | 0.00 |
| 2799 | −13.62 | 0.94 | 0.30 | 0.00 | 0.23 | 0.95 |
| 1433 | −21.81 | 0.48 | 0.33 | 0.24 | 0.21 | 0.98 |
| 1837 | −19.50 | 0.59 | 0.30 | 0.20 | 0.28 | 0.63 |
| 4238 | −17.25 | 0.54 | 0.32 | 0.28 | 0.21 | 0.30 |
| 2202 | −17.51 | 0.59 | 0.31 | 0.20 | 0.00 | 0.00 |

TABLE 7B-continued

| Seq ID No | SolvScore | AggScore | Allergenicity | Toxicity | Antinutricity | Human Homology |
|---|---|---|---|---|---|---|
| 1919 | −17.71 | 0.62 | 0.24 | 0.26 | 0.29 | 0.27 |
| 3911 | −16.41 | 0.77 | 0.26 | 0.00 | 0.23 | 0.34 |
| 3569 | −13.40 | 0.95 | 0.33 | 0.23 | 0.21 | 0.27 |
| 89 | −15.83 | 0.76 | 0.31 | 0.00 | 0.23 | 0.91 |
| 4024 | −16.44 | 0.64 | 0.31 | 0.00 | 0.25 | 0.36 |
| 2697 | −17.36 | 0.48 | 0.27 | 0.27 | 0.24 | 0.97 |
| 3825 | −16.80 | 1.05 | 0.21 | 0.00 | 0.29 | 0.33 |
| 4178 | −13.84 | 0.92 | 0.20 | 0.00 | 0.28 | 0.41 |
| 2156 | −21.84 | 0.48 | 0.33 | 0.24 | 0.21 | 0.98 |
| 1867 | −19.79 | 0.51 | 0.33 | 0.00 | 0.26 | 0.30 |
| 1234 | −20.34 | 0.59 | 0.31 | 0.21 | 0.00 | 0.46 |
| 2468 | −18.22 | 0.59 | 0.33 | 0.26 | 0.25 | 1.00 |
| 3566 | −16.43 | 0.75 | 0.24 | 0.25 | 0.32 | 0.30 |
| 3514 | −17.70 | 1.04 | 0.19 | 0.33 | 0.33 | 0.41 |
| 4173 | −15.21 | 0.96 | 0.29 | 0.25 | 0.25 | 0.30 |
| 709 | −17.14 | 0.58 | 0.31 | 0.20 | 0.25 | 0.63 |
| 3956 | −17.30 | 0.70 | 0.20 | 0.00 | 0.29 | 0.32 |
| 2110 | −15.86 | 0.71 | 0.27 | 0.23 | 0.25 | 0.81 |
| 54 | −18.30 | 0.58 | 0.29 | 0.25 | 0.24 | 0.88 |
| 3925 | −15.58 | 0.62 | 0.31 | 0.00 | 0.23 | 0.27 |
| 2910 | −21.23 | 0.52 | 0.29 | 0.22 | 0.00 | 0.22 |
| 1111 | −14.66 | 0.89 | 0.23 | 0.24 | 0.28 | 0.37 |
| 1071 | −20.49 | 0.58 | 0.29 | 0.00 | 0.24 | 0.29 |
| 1689 | −17.13 | 0.66 | 0.31 | 0.00 | 0.00 | 0.52 |
| 469 | −16.59 | 0.57 | 0.22 | 0.28 | 0.25 | 0.86 |
| 3976 | −14.46 | 0.99 | 0.22 | 0.31 | 0.25 | 0.28 |
| 1203 | −22.02 | 0.30 | 0.24 | 0.28 | 0.24 | 0.28 |
| 223 | −16.44 | 0.73 | 0.28 | 0.24 | 0.20 | 0.28 |
| 1441 | −12.67 | 0.97 | 0.11 | 0.39 | 0.31 | 0.38 |
| 1005 | −17.12 | 0.54 | 0.29 | 0.00 | 0.00 | 0.31 |
| 344 | −18.02 | 0.58 | 0.25 | 0.28 | 0.22 | 0.33 |
| 1832 | −17.14 | 0.51 | 0.31 | 0.00 | 0.25 | 0.25 |
| 2525 | −19.16 | 0.61 | 0.32 | 0.23 | 0.22 | 0.79 |
| 4189 | −15.25 | 0.92 | 0.28 | 0.27 | 0.00 | 0.74 |
| 3816 | −19.02 | 0.58 | 0.28 | 0.00 | 0.25 | 0.29 |
| 2108 | −18.89 | 0.61 | 0.29 | 0.00 | 0.25 | 0.74 |
| 1159 | −18.00 | 0.51 | 0.29 | 0.23 | 0.24 | 0.60 |
| 534 | −17.93 | 0.64 | 0.31 | 0.00 | 0.22 | 0.00 |
| 3299 | −16.28 | 0.85 | 0.28 | 0.25 | 0.26 | 0.46 |
| 1325 | −16.76 | 0.77 | 0.33 | 0.00 | 0.00 | 0.29 |
| 1814 | −18.97 | 0.61 | 0.30 | 0.00 | 0.00 | 0.42 |
| 3605 | −16.19 | 0.60 | 0.22 | 0.25 | 0.26 | 0.28 |
| 4132 | −17.41 | 0.75 | 0.29 | 0.00 | 0.00 | 0.26 |
| 1776 | −15.63 | 0.97 | 0.30 | 0.23 | 0.24 | 0.00 |
| 357 | −17.98 | 0.87 | 0.31 | 0.00 | 0.22 | 0.00 |
| 2702 | −18.32 | 0.62 | 0.30 | 0.00 | 0.22 | 0.73 |
| 3962 | −18.81 | 0.69 | 0.33 | 0.24 | 0.00 | 0.38 |
| 3454 | −18.24 | 0.86 | 0.29 | 0.00 | 0.24 | 0.30 |
| 3983 | −16.22 | 0.81 | 0.29 | 0.00 | 0.22 | 0.22 |
| 3591 | −18.96 | 0.53 | 0.29 | 0.26 | 0.26 | 0.88 |
| 2101 | −17.25 | 0.61 | 0.27 | 0.26 | 0.25 | 0.98 |
| 1213 | −12.68 | 1.25 | 0.27 | 0.21 | 0.23 | 0.31 |
| 1119 | −15.92 | 0.69 | 0.31 | 0.00 | 0.25 | 0.34 |
| 1197 | −18.25 | 0.59 | 0.32 | 0.23 | 0.26 | 0.25 |
| 2693 | −19.37 | 0.67 | 0.30 | 0.23 | 0.23 | 0.77 |
| 484 | −18.51 | 0.67 | 0.27 | 0.00 | 0.00 | 0.24 |
| 866 | −17.20 | 0.71 | 0.23 | 0.25 | 0.30 | 0.30 |
| 475 | −16.68 | 0.85 | 0.20 | 0.17 | 0.28 | 0.00 |
| 4150 | −17.81 | 0.61 | 0.39 | 0.00 | 0.22 | 0.32 |
| 1882 | −16.21 | 0.58 | 0.27 | 0.00 | 0.28 | 0.84 |
| 1317 | −17.23 | 0.59 | 0.31 | 0.00 | 0.22 | 0.29 |
| 481 | −14.92 | 1.28 | 0.26 | 0.27 | 0.26 | 0.31 |
| 3807 | −16.59 | 0.79 | 0.30 | 0.27 | 0.27 | 0.32 |
| 4026 | −20.21 | 0.52 | 0.31 | 0.00 | 0.25 | 0.00 |
| 120 | −16.57 | 0.64 | 0.33 | 0.20 | 0.25 | 0.26 |
| 3594 | −14.60 | 1.09 | 0.30 | 0.23 | 0.23 | 0.76 |
| 3968 | −19.46 | 0.69 | 0.30 | 0.00 | 0.20 | 0.00 |
| 1773 | −17.69 | 0.53 | 0.27 | 0.00 | 0.00 | 0.00 |
| 1335 | −18.51 | 0.52 | 0.30 | 0.00 | 0.27 | 0.82 |
| 3 | −20.64 | 0.56 | 0.25 | 0.28 | 0.00 | 0.92 |
| 1054 | −14.97 | 1.12 | 0.20 | 0.31 | 0.29 | 0.91 |
| 2235 | −19.14 | 0.47 | 0.31 | 0.23 | 0.00 | 0.97 |
| 4011 | −10.82 | 1.15 | 0.23 | 0.00 | 0.26 | 0.94 |
| 2160 | −18.47 | 0.59 | 0.33 | 0.25 | 0.26 | 0.85 |
| 2699 | −21.38 | 0.62 | 0.30 | 0.00 | 0.00 | 0.94 |
| 1421 | −19.03 | 0.60 | 0.29 | 0.00 | 0.25 | 0.34 |
| 2978 | −16.80 | 0.90 | 0.30 | 0.00 | 0.00 | 0.27 |
| 4388 | −20.52 | 0.61 | 0.29 | 0.25 | 0.25 | 0.29 |
| 62 | −17.27 | 0.39 | 0.27 | 0.00 | 0.23 | 0.89 |
| 251 | −15.12 | 0.92 | 0.29 | 0.29 | 0.27 | 0.97 |
| 3370 | −13.90 | 0.84 | 0.30 | 0.28 | 0.25 | 0.34 |
| 1229 | −18.50 | 0.55 | 0.27 | 0.00 | 0.26 | 0.30 |
| 4229 | −16.46 | 0.71 | 0.19 | 0.35 | 0.29 | 0.25 |
| 3101 | −17.11 | 0.55 | 0.32 | 0.24 | 0.22 | 0.24 |

TABLE 8A

| SeqIDNo | UniProtID | Fragment Ends | EAA Complete | [EAA] | [NEAA] | PDCAAS | Dist. Target |
|---|---|---|---|---|---|---|---|
| 4199 | Q9SZW4 | 277:380 | 1 | 0.58 | 0.42 | 2.20 | 0.0533 |
| 3836 | Q9FUG4 | 412:476 | 1 | 0.59 | 0.41 | 2.10 | 0.0593 |
| 4343 | Q9Y802 | 504:615 | 1 | 0.62 | 0.38 | 2.08 | 0.0778 |
| 4163 | Q9SUP0 | 4:157 | 1 | 0.65 | 0.35 | 2.07 | 0.0866 |
| 2017 | Q1WLP9 | 170:279 | 1 | 0.65 | 0.35 | 2.11 | 0.0873 |
| 4401 | Q9ZVE0 | 63:170 | 1 | 0.56 | 0.44 | 2.01 | 0.0410 |
| 1275 | P43544 | 7:116 | 1 | 0.53 | 0.47 | 2.03 | 0.0477 |
| 4190 | Q9SY55 | 234:340 | 1 | 0.58 | 0.42 | 2.01 | 0.0548 |
| 709 | P08417 | 357:481 | 1 | 0.54 | 0.46 | 1.97 | 0.0574 |
| 1234 | P40527 | 728:868 | 1 | 0.53 | 0.47 | 1.95 | 0.0652 |
| 2202 | Q3E7D1 | 154:352 | 1 | 0.56 | 0.44 | 1.95 | 0.0661 |
| 4024 | Q9P7D7 | 190:372 | 1 | 0.52 | 0.48 | 1.98 | 0.0677 |
| 89 | A6QQL0 | 269:436 | 1 | 0.59 | 0.41 | 1.96 | 0.0701 |
| 1433 | P53666 | 343:479 | 1 | 0.59 | 0.41 | 1.96 | 0.0701 |
| 2799 | Q65AC2 | 315:513 | 1 | 0.60 | 0.40 | 1.96 | 0.0701 |
| 1919 | Q0WVW7 | 702:769 | 1 | 0.58 | 0.42 | 2.04 | 0.0706 |
| 268 | O23278 | 380:461 | 1 | 0.64 | 0.36 | 1.96 | 0.0708 |
| 1837 | Q08960 | 543:629 | 1 | 0.56 | 0.44 | 1.99 | 0.0723 |
| 195 | O04722 | 303:355 | 1 | 0.67 | 0.33 | 1.98 | 0.0747 |
| 2468 | Q58D00 | 227:349 | 0 | 0.53 | 0.47 | 2.01 | 0.0756 |
| 1689 | P93028 | 905:985 | 1 | 0.56 | 0.44 | 1.95 | 0.0770 |
| 2156 | Q32L23 | 343:479 | 1 | 0.58 | 0.42 | 1.96 | 0.0771 |
| 3569 | Q94LW6 | 205:361 | 1 | 0.60 | 0.40 | 1.99 | 0.0778 |
| 2910 | Q6LA56 | 26:154 | 1 | 0.58 | 0.42 | 2.04 | 0.0787 |
| 1867 | Q09889 | 197:311 | 1 | 0.53 | 0.47 | 1.96 | 0.0794 |

TABLE 8A-continued

| SeqIDNo | UniProtID | Fragment Ends | EAA Complete | [EAA] | [NEAA] | PDCAAS | Dist. Target |
|---|---|---|---|---|---|---|---|
| 4238 | Q9UTL9 | 261:383 | 1 | 0.59 | 0.41 | 2.00 | 0.0796 |
| 2697 | Q5ZIL2 | 19:105 | 1 | 0.56 | 0.44 | 1.96 | 0.0806 |
| 3925 | Q9LK39 | 366:485 | 1 | 0.57 | 0.43 | 1.97 | 0.0822 |
| 54 | A4IFA3 | 595:712 | 1 | 0.56 | 0.44 | 2.00 | 0.0828 |
| 2110 | Q29RU8 | 504:605 | 1 | 0.59 | 0.41 | 1.95 | 0.0834 |
| 3911 | Q9LD37 | 224:300 | 1 | 0.62 | 0.38 | 1.96 | 0.0840 |
| 1071 | P30620 | 434:546 | 1 | 0.59 | 0.41 | 2.03 | 0.0851 |
| 2467 | Q58CW4 | 227:284 | 1 | 0.64 | 0.36 | 1.97 | 0.0876 |
| 4173 | Q9SW17 | 332:483 | 1 | 0.61 | 0.39 | 1.97 | 0.0879 |
| 3566 | Q94KB7 | 394:462 | 1 | 0.61 | 0.39 | 1.96 | 0.0883 |
| 4178 | Q9SWS1 | 22:81 | 1 | 0.63 | 0.37 | 1.99 | 0.0893 |
| 3956 | Q9LVQ5 | 53:111 | 1 | 0.63 | 0.37 | 1.97 | 0.0904 |
| 469 | O77480 | 292:356 | 1 | 0.55 | 0.45 | 1.97 | 0.0906 |
| 1203 | P38960 | 408:472 | 1 | 0.57 | 0.43 | 1.96 | 0.0965 |
| 3825 | Q9FLT4 | 306:360 | 1 | 0.69 | 0.31 | 2.04 | 0.1020 |
| 223 | O13712 | 677:807 | 1 | 0.59 | 0.41 | 2.00 | 0.1027 |
| 3514 | Q92182 | 3:50 | 1 | 0.63 | 0.37 | 2.05 | 0.1076 |
| 1111 | P32584 | 95:169 | 1 | 0.65 | 0.35 | 2.04 | 0.1082 |
| 3454 | Q8VZZ4 | 791:964 | 1 | 0.54 | 0.46 | 1.91 | 0.0503 |
| 534 | O94265 | 97:269 | 1 | 0.55 | 0.45 | 1.91 | 0.0520 |
| 1832 | Q08905 | 454:639 | 1 | 0.54 | 0.46 | 1.86 | 0.0524 |
| 1814 | Q07527 | 1305:1435 | 1 | 0.57 | 0.43 | 1.87 | 0.0532 |
| 2702 | Q5ZKB7 | 194:377 | 1 | 0.54 | 0.46 | 1.92 | 0.0535 |
| 4150 | Q9SNX8 | 43:233 | 1 | 0.54 | 0.46 | 1.87 | 0.0542 |
| 267 | O23255 | 298:473 | 1 | 0.55 | 0.45 | 1.86 | 0.0546 |
| 2101 | Q29449 | 706:835 | 1 | 0.52 | 0.48 | 1.94 | 0.0560 |
| 1335 | P48034 | 235:348 | 1 | 0.55 | 0.45 | 1.90 | 0.0575 |
| 3962 | Q9LXW7 | 90:222 | 1 | 0.55 | 0.45 | 1.91 | 0.0593 |
| 3605 | Q96323 | 219:285 | 1 | 0.56 | 0.44 | 1.94 | 0.0594 |
| 1159 | P36421 | 1:126 | 1 | 0.54 | 0.46 | 1.87 | 0.0597 |
| 1005 | P25847 | 46:133 | 1 | 0.55 | 0.45 | 1.86 | 0.0604 |
| 344 | O49160 | 246:319 | 1 | 0.62 | 0.38 | 1.85 | 0.0610 |
| 2108 | Q29RL1 | 292:396 | 1 | 0.63 | 0.37 | 1.89 | 0.0612 |
| 2699 | Q5ZJ43 | 484:641 | 1 | 0.55 | 0.45 | 1.89 | 0.0616 |
| 120 | A8MQA3 | 127:245 | 1 | 0.53 | 0.47 | 1.95 | 0.0622 |
| 2525 | Q5F361 | 127:253 | 1 | 0.56 | 0.44 | 1.87 | 0.0624 |
| 3101 | Q7XRA1 | 177:332 | 1 | 0.52 | 0.48 | 1.86 | 0.0631 |
| 2235 | Q3MHL4 | 271:420 | 1 | 0.56 | 0.44 | 1.90 | 0.0633 |
| 1776 | Q04658 | 238:369 | 1 | 0.56 | 0.44 | 1.90 | 0.0652 |
| 3816 | Q9FKR3 | 144:245 | 1 | 0.59 | 0.41 | 1.85 | 0.0655 |
| 2160 | Q32LB9 | 472:609 | 1 | 0.58 | 0.42 | 1.87 | 0.0656 |
| 484 | O80970 | 97:179 | 1 | 0.54 | 0.46 | 1.85 | 0.0665 |
| 475 | O80580 | 1:62 | 1 | 0.59 | 0.41 | 1.95 | 0.0666 |
| 3983 | Q9M175 | 261:435 | 1 | 0.59 | 0.41 | 1.86 | 0.0673 |
| 3792 | Q9FFT9 | 138:337 | 1 | 0.55 | 0.45 | 1.90 | 0.0678 |
| 1317 | P46682 | 341:510 | 1 | 0.58 | 0.42 | 1.91 | 0.0679 |
| 3 | A0A1F3 | 256:332 | 1 | 0.57 | 0.43 | 1.89 | 0.0692 |
| 328 | O43043 | 629:731 | 1 | 0.56 | 0.44 | 1.88 | 0.0703 |
| 985 | P24719 | 9:132 | 1 | 0.51 | 0.49 | 1.90 | 0.0708 |
| 2693 | Q5ZIE4 | 6:158 | 1 | 0.60 | 0.40 | 1.94 | 0.0709 |
| 4388 | Q9ZQR8-2 | 66:167 | 1 | 0.57 | 0.43 | 1.91 | 0.0710 |
| 1229 | P40395 | 602:693 | 1 | 0.54 | 0.46 | 1.91 | 0.0711 |
| 1197 | P38803 | 112:228 | 1 | 0.56 | 0.45 | 1.95 | 0.0715 |
| 3968 | Q9LYG9 | 240:435 | 1 | 0.60 | 0.40 | 1.88 | 0.0717 |
| 3299 | Q8GXD6 | 255:338 | 1 | 0.60 | 0.40 | 1.94 | 0.0723 |
| 324 | O42939 | 3:198 | 1 | 0.53 | 0.47 | 1.89 | 0.0733 |
| 357 | O49621 | 14:205 | 1 | 0.62 | 0.38 | 1.91 | 0.0735 |
| 852 | P15398 | 1465:1537 | 1 | 0.55 | 0.45 | 1.86 | 0.0738 |
| 4026 | Q9P7K5 | 783:939 | 1 | 0.55 | 0.45 | 1.90 | 0.0743 |
| 4132 | Q9SJ73 | 323:417 | 1 | 0.60 | 0.40 | 1.93 | 0.0743 |
| 1325 | P47082 | 386:521 | 1 | 0.60 | 0.40 | 1.88 | 0.0745 |
| 3955 | Q9LVF0 | 30:192 | 1 | 0.51 | 0.49 | 1.89 | 0.0756 |
| 3807 | Q9FIJ0 | 396:498 | 1 | 0.55 | 0.45 | 1.87 | 0.0764 |
| 1421 | P53119 | 712:792 | 1 | 0.58 | 0.42 | 1.88 | 0.0797 |
| 1119 | P33333 | 28:198 | 1 | 0.59 | 0.41 | 1.85 | 0.0798 |
| 3370 | Q8LPK2 | 288:379 | 1 | 0.59 | 0.41 | 1.85 | 0.0801 |
| 3919 | Q9LFN5 | 229:428 | 1 | 0.56 | 0.44 | 1.87 | 0.0801 |
| 1827 | Q08217 | 544:679 | 1 | 0.57 | 0.43 | 1.86 | 0.0807 |
| 1995 | Q1JQA1 | 160:326 | 1 | 0.52 | 0.48 | 1.93 | 0.0810 |
| 3351 | Q8L500 | 46:85 | 0 | 0.52 | 0.48 | 1.89 | 0.0812 |
| 3874 | Q9HE16 | 395:464 | 1 | 0.56 | 0.44 | 1.94 | 0.0818 |
| 45 | A2VDP5 | 206:306 | 1 | 0.54 | 0.46 | 1.90 | 0.0818 |
| 1213 | P39535 | 411:492 | 1 | 0.63 | 0.37 | 1.92 | 0.0833 |
| 1882 | Q0P5F2 | 163:266 | 1 | 0.56 | 0.44 | 1.92 | 0.0848 |
| 1468 | P54612 | 422:589 | 1 | 0.55 | 0.45 | 1.83 | 0.0381 |

TABLE 8B

| Seq ID No | SolvScore | AggScore | Allergenicity | Toxicity | Anti-nutricity | Human Homology |
|---|---|---|---|---|---|---|
| 4199 | −14.98 | 1.08 | 0.31 | 0.25 | 0.23 | 0.37 |
| 3836 | −19.27 | 0.59 | 0.23 | 0.25 | 0.24 | 0.72 |
| 4343 | −18.71 | 0.56 | 0.28 | 0.28 | 0.25 | 0.29 |
| 4163 | −13.46 | 1.07 | 0.32 | 0.20 | 0.23 | 0.23 |
| 2017 | −12.50 | 1.23 | 0.29 | 0.00 | 0.26 | 0.87 |
| 4401 | −19.75 | 0.65 | 0.29 | 0.24 | 0.00 | 0.45 |
| 1275 | −18.77 | 0.61 | 0.30 | 0.25 | 0.21 | 0.00 |
| 4190 | −15.00 | 0.94 | 0.28 | 0.27 | 0.00 | 0.74 |
| 709 | −17.14 | 0.58 | 0.31 | 0.20 | 0.25 | 0.63 |
| 1234 | −20.34 | 0.59 | 0.31 | 0.21 | 0.00 | 0.46 |
| 2202 | −17.51 | 0.59 | 0.31 | 0.20 | 0.00 | 0.00 |
| 4024 | −16.44 | 0.64 | 0.31 | 0.00 | 0.25 | 0.36 |
| 89 | −15.83 | 0.76 | 0.31 | 0.00 | 0.23 | 0.91 |
| 1433 | −21.81 | 0.48 | 0.33 | 0.24 | 0.21 | 0.98 |
| 2799 | −13.62 | 0.94 | 0.30 | 0.00 | 0.23 | 0.95 |
| 1919 | −17.71 | 0.62 | 0.24 | 0.26 | 0.29 | 0.27 |
| 268 | −19.84 | 0.69 | 0.25 | 0.00 | 0.26 | 0.00 |
| 1837 | −19.50 | 0.59 | 0.30 | 0.20 | 0.28 | 0.63 |
| 195 | −16.02 | 0.90 | 0.18 | 0.00 | 0.29 | 0.35 |
| 2468 | −18.22 | 0.59 | 0.33 | 0.26 | 0.25 | 1.00 |
| 1689 | −17.13 | 0.66 | 0.31 | 0.00 | 0.00 | 0.52 |
| 2156 | −21.84 | 0.48 | 0.33 | 0.24 | 0.21 | 0.98 |
| 3569 | −13.40 | 0.95 | 0.33 | 0.23 | 0.21 | 0.27 |
| 2910 | −21.23 | 0.52 | 0.29 | 0.22 | 0.00 | 0.22 |
| 1867 | −19.79 | 0.51 | 0.33 | 0.00 | 0.26 | 0.30 |
| 4238 | −17.25 | 0.54 | 0.32 | 0.28 | 0.21 | 0.30 |
| 2697 | −17.36 | 0.48 | 0.27 | 0.27 | 0.24 | 0.97 |
| 3925 | −15.58 | 0.62 | 0.31 | 0.00 | 0.23 | 0.27 |
| 54 | −18.30 | 0.58 | 0.29 | 0.25 | 0.24 | 0.88 |
| 2110 | −15.86 | 0.71 | 0.27 | 0.23 | 0.25 | 0.81 |
| 3911 | −16.41 | 0.77 | 0.26 | 0.00 | 0.23 | 0.34 |
| 1071 | −20.49 | 0.58 | 0.29 | 0.00 | 0.24 | 0.29 |
| 2467 | −17.40 | 1.05 | 0.20 | 0.29 | 0.00 | 0.84 |
| 4173 | −15.21 | 0.96 | 0.29 | 0.25 | 0.25 | 0.30 |
| 3566 | −16.43 | 0.75 | 0.24 | 0.25 | 0.32 | 0.30 |
| 4178 | −13.84 | 0.92 | 0.20 | 0.00 | 0.28 | 0.41 |
| 3956 | −17.30 | 0.70 | 0.20 | 0.00 | 0.29 | 0.32 |
| 469 | −16.59 | 0.57 | 0.22 | 0.28 | 0.25 | 0.86 |
| 1203 | −22.02 | 0.30 | 0.24 | 0.28 | 0.24 | 0.28 |
| 3825 | −16.80 | 1.05 | 0.21 | 0.00 | 0.29 | 0.33 |
| 223 | −16.44 | 0.73 | 0.28 | 0.24 | 0.20 | 0.28 |
| 3514 | −17.70 | 1.04 | 0.19 | 0.33 | 0.33 | 0.41 |
| 1111 | −14.66 | 0.89 | 0.23 | 0.24 | 0.28 | 0.37 |
| 3454 | −18.24 | 0.86 | 0.29 | 0.00 | 0.24 | 0.30 |
| 534 | −17.93 | 0.64 | 0.31 | 0.00 | 0.22 | 0.00 |
| 1832 | −17.14 | 0.51 | 0.31 | 0.00 | 0.25 | 0.25 |
| 1814 | −18.97 | 0.61 | 0.30 | 0.00 | 0.00 | 0.42 |
| 2702 | −18.32 | 0.62 | 0.30 | 0.00 | 0.22 | 0.73 |
| 4150 | −17.81 | 0.61 | 0.39 | 0.00 | 0.22 | 0.32 |
| 267 | −19.74 | 0.53 | 0.35 | 0.00 | 0.23 | 0.56 |
| 2101 | −17.25 | 0.61 | 0.27 | 0.26 | 0.25 | 0.98 |
| 1335 | −18.51 | 0.52 | 0.30 | 0.00 | 0.27 | 0.82 |
| 3962 | −18.81 | 0.69 | 0.33 | 0.24 | 0.00 | 0.38 |
| 3605 | −16.19 | 0.60 | 0.22 | 0.25 | 0.26 | 0.28 |
| 1159 | −18.00 | 0.51 | 0.29 | 0.23 | 0.24 | 0.60 |
| 1005 | −17.12 | 0.54 | 0.29 | 0.00 | 0.00 | 0.31 |
| 344 | −18.02 | 0.58 | 0.25 | 0.28 | 0.22 | 0.33 |
| 2108 | −18.89 | 0.61 | 0.29 | 0.00 | 0.25 | 0.74 |
| 2699 | −21.38 | 0.62 | 0.30 | 0.00 | 0.00 | 0.94 |
| 120 | −16.57 | 0.64 | 0.33 | 0.20 | 0.25 | 0.26 |
| 2525 | −19.16 | 0.61 | 0.32 | 0.23 | 0.22 | 0.79 |
| 3101 | −17.11 | 0.55 | 0.32 | 0.24 | 0.22 | 0.24 |
| 2235 | −19.14 | 0.47 | 0.31 | 0.23 | 0.00 | 0.97 |
| 1776 | −15.63 | 0.97 | 0.30 | 0.23 | 0.24 | 0.00 |
| 3816 | −19.02 | 0.58 | 0.28 | 0.00 | 0.25 | 0.29 |
| 2160 | −18.47 | 0.59 | 0.33 | 0.25 | 0.26 | 0.85 |
| 484 | −18.51 | 0.67 | 0.27 | 0.00 | 0.00 | 0.24 |
| 475 | −16.68 | 0.85 | 0.20 | 0.17 | 0.28 | 0.00 |
| 3983 | −16.22 | 0.81 | 0.29 | 0.00 | 0.22 | 0.22 |
| 3792 | −19.87 | 0.56 | 0.32 | 0.00 | 0.00 | 0.55 |
| 1317 | −17.23 | 0.59 | 0.31 | 0.00 | 0.22 | 0.29 |
| 3 | −20.64 | 0.56 | 0.25 | 0.28 | 0.00 | 0.92 |
| 328 | −18.73 | 0.67 | 0.27 | 0.25 | 0.26 | 0.23 |
| 985 | −20.85 | 0.48 | 0.30 | 0.25 | 0.24 | 0.29 |
| 2693 | −19.37 | 0.67 | 0.30 | 0.23 | 0.23 | 0.77 |
| 4388 | −20.52 | 0.61 | 0.29 | 0.25 | 0.25 | 0.29 |
| 1229 | −18.50 | 0.55 | 0.27 | 0.00 | 0.26 | 0.30 |
| 1197 | −18.25 | 0.59 | 0.32 | 0.23 | 0.26 | 0.25 |
| 3968 | −19.46 | 0.69 | 0.30 | 0.00 | 0.20 | 0.00 |
| 3299 | −16.28 | 0.85 | 0.28 | 0.25 | 0.26 | 0.46 |
| 324 | −18.38 | 0.53 | 0.31 | 0.00 | 0.21 | 0.58 |
| 357 | −17.98 | 0.87 | 0.31 | 0.00 | 0.22 | 0.00 |
| 852 | −20.90 | 0.46 | 0.30 | 0.29 | 0.35 | 0.23 |
| 4026 | −20.21 | 0.52 | 0.31 | 0.00 | 0.25 | 0.00 |
| 4132 | −17.41 | 0.75 | 0.29 | 0.00 | 0.00 | 0.26 |
| 1325 | −16.76 | 0.77 | 0.33 | 0.00 | 0.00 | 0.29 |
| 3955 | −21.48 | 0.47 | 0.30 | 0.19 | 0.00 | 0.00 |
| 3807 | −16.59 | 0.79 | 0.30 | 0.27 | 0.27 | 0.32 |
| 1421 | −19.03 | 0.60 | 0.29 | 0.00 | 0.25 | 0.34 |
| 1119 | −15.92 | 0.69 | 0.31 | 0.00 | 0.25 | 0.34 |
| 3370 | −13.90 | 0.84 | 0.30 | 0.28 | 0.25 | 0.34 |
| 3919 | −20.41 | 0.50 | 0.33 | 0.00 | 0.22 | 0.24 |
| 1827 | −19.36 | 0.47 | 0.31 | 0.00 | 0.28 | 0.00 |
| 1995 | −19.08 | 0.50 | 0.30 | 0.00 | 0.00 | 0.78 |
| 3351 | −20.75 | 0.61 | 0.15 | 0.35 | 0.31 | 0.35 |
| 3874 | −18.32 | 0.55 | 0.22 | 0.00 | 0.00 | 0.00 |
| 45 | −21.38 | 0.46 | 0.29 | 0.25 | 0.27 | 0.79 |
| 1213 | −12.68 | 1.25 | 0.27 | 0.21 | 0.23 | 0.31 |
| 1882 | −16.21 | 0.58 | 0.27 | 0.00 | 0.28 | 0.84 |
| 1468 | −17.90 | 0.57 | 0.31 | 0.23 | 0.00 | 1.00 |

FIGS. 5-8 present an analysis of the essential and non-essential amino acid content of four of the identified fragments that have among the highest PCDAAS scores.

Figure 5:
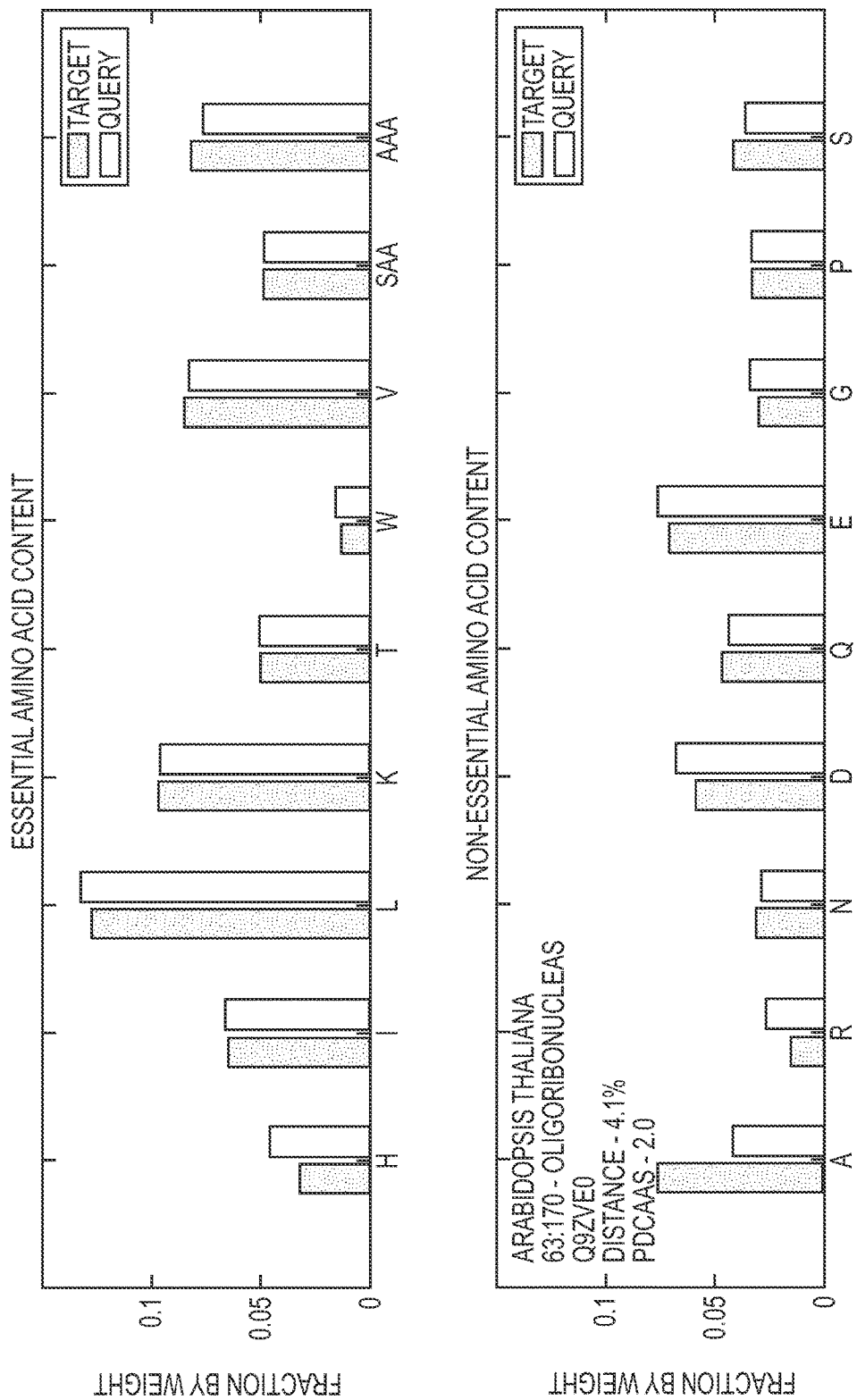
FIG. 5 shows the essential and non-essential amino acid content of the polypeptide fragment from amino acid 63 to amino acid 170 of the *Arabidopsis thaliana* oligoribonuclease protein (UniProt Q9ZVE0) (SEQ ID NO: 4401). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the polypeptide fragment from amino acid 63 to amino acid 170 of the *Arabidopsis thaliana* oligoribonuclease protein (UniProt Q9ZVE0) (SEQ ID NO: 4401) is presented in FIG. 5. The fragment has a PCDAAS value of 2.01 and a Euclidian distance from a 60/40 EAA/NEAA (Whey) target amino acid profile of 0.041, and a Euclidian distance from a 70/30 EAA/NEAA (Whey) target amino acid profile of 0.058. This increase in distance is due to a reduced match between both the NEAA and EAA/CEAA distributions. In particular, the EAA/CEAA distribution of this polypeptide is a far better match to the 60/40 EAA/NEAA (Whey) distribution (0.015) than the 70/30 EAA/NEAA (Whey) (0.033). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (right bar) and compares it to the fraction by weight of each type of non-essential amino acid present in whey protein (left bar).

Figure 6:
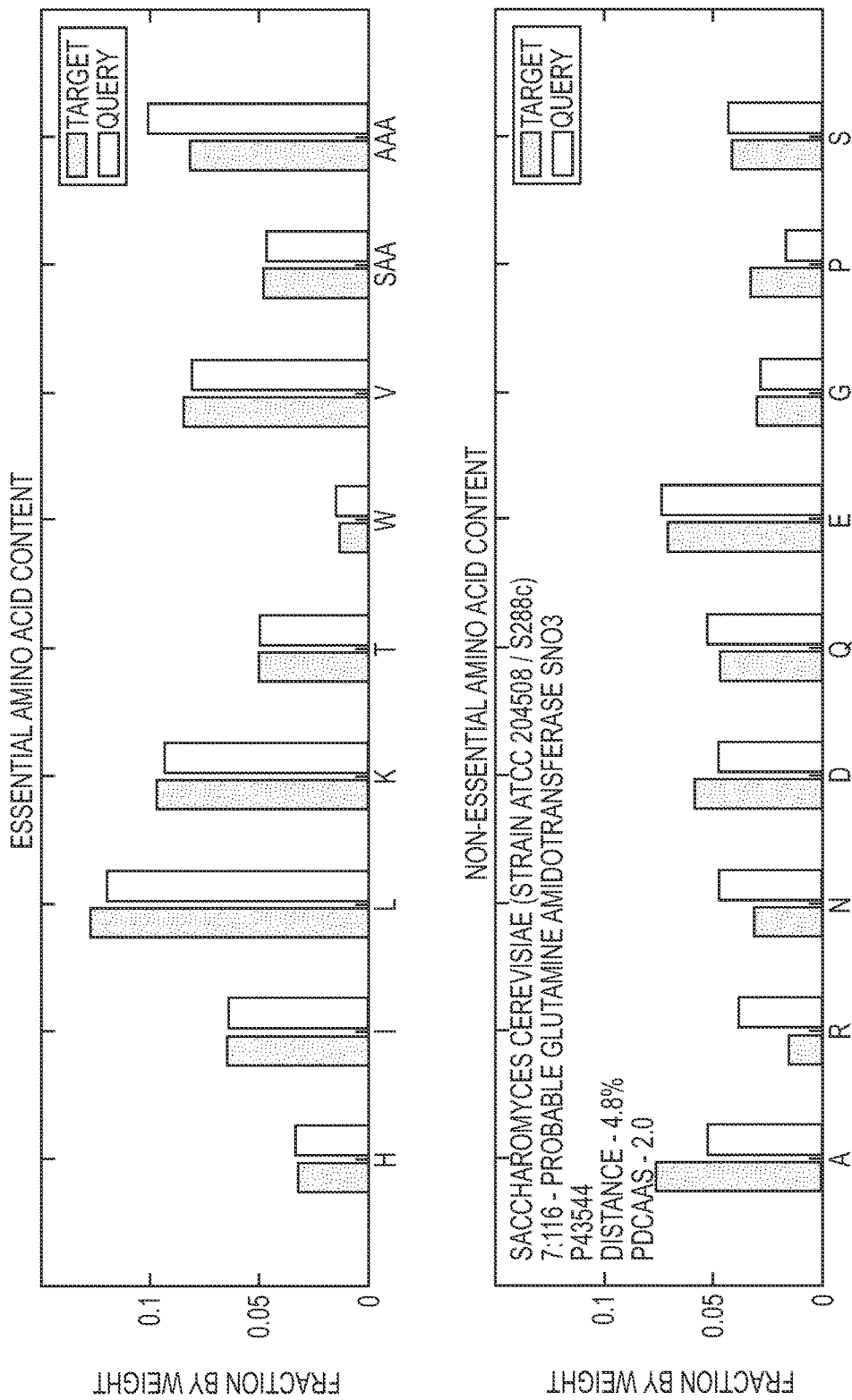
FIG. 6 shows the essential and non-essential amino acid content of the polypeptide fragment from amino acid 7 to amino acid 116 of the *Saccharomyces cerevisiae* probable glutamine amidotransferase protein SNO3 (UniProt P43544) (SEQ ID NO: 1275). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the polypeptide fragment from amino acid 7 to amino acid 116 of the *Saccharomyces cerevisiae* probable glutamine amidotransferase protein SNO3 (UniProt P43544) (SEQ ID NO: 1275) is presented in FIG. 6. The fragment has a PCDAAS value of 1.98 and a Euclidian distance from a 60/40 EAA/NEAA (Whey) target amino acid profile of 0.048, and a Euclidian distance from a 70/30 EAA/NEAA (Whey) target amino acid profile of 0.062. This increase in distance is due to a reduced match between both the NEAA and EAA/CEAA distributions. In particular, the EAA/CEAA distribution of this polypeptide is a far better match to the 60/40 EAA/NEAA (Whey) distribution (0.010) than the 70/30 EAA/NEAA (Whey) (0.042). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

Figure 7:
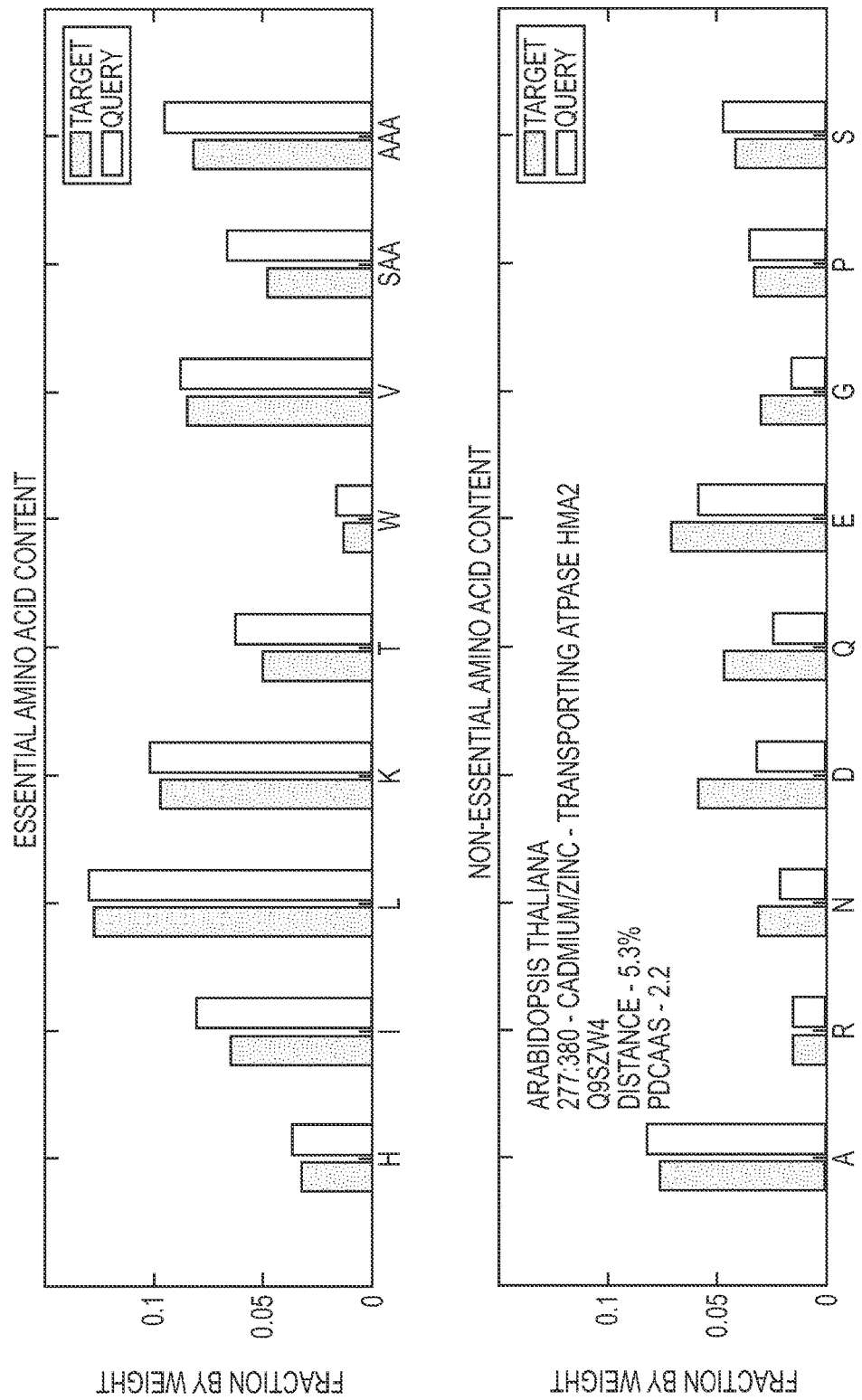
FIG. 7 shows the essential and non-essential amino acid content of the polypeptide fragment from amino acid 277 to amino acid 380 of the *Arabidopsis thaliana* cadmium/zinc-transporting ATPase HMA2 protein (UniProt Q9SZW4) (SEQ ID NO: 4199). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the polypeptide fragment from amino acid 277 to amino acid 380 of the *Arabidopsis thaliana* cadmium/zinc-transporting ATPase HMA2 protein (UniProt Q9SZW4) (SEQ ID NO: 4199) is presented in FIG. 7. The fragment has a PCDAAS value of 2.20, a Euclidian distance from a 60/40 EAA/NEAA (Whey) target amino acid profile of 0.053, and a Euclidian distance from a 70/30 EAA/CEAA (Whey) target amino acid profile of 0.0459This decrease in distance is primarily due to an improved match between the NEAA distribution of the polypeptide fragment and the 70/30 EAA/NEAA (Whey) NEAA distribution (0.036) versus that of the 60/40 EAA/CEAA (Whey) NEAA distribution (0.044). The top panel presents the fraction by weight of each type/category of essential amino acid in the fragment (white) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

Figure 8:
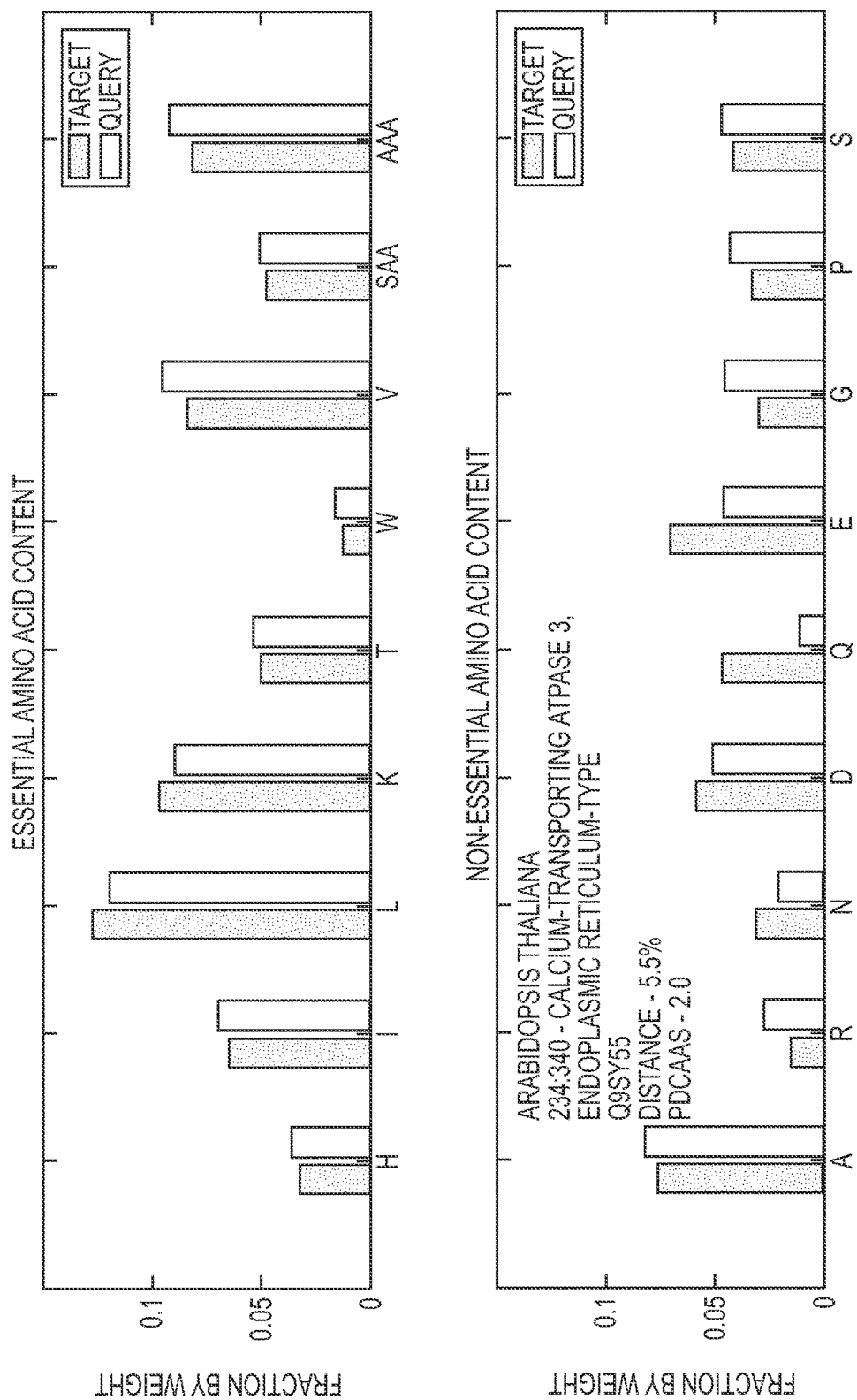
FIG. 8 shows the essential and non-essential amino acid content of the polypeptide fragment from amino acid 234 to amino acid 340 of the *Arabidopsis thaliana* calcium transporting ATPase 3, endoplasmic reticulum-type protein (UniProt Q9SY55) (SEQ ID NO: 4190). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the polypeptide fragment from amino acid 234 to amino acid 340 of the *Arabidopsis thaliana* calcium transporting ATPase 3, endoplasmic reticulum-type protein (UniProt Q9SY55) (SEQ ID NO: 4190) is presented in FIG. 8. The fragment has a PCDAAS value of 1.91, a Euclidian distance from a 60/40 EAA/NEAA (Whey) target amino acid profile of 0.054, and a Euclidian distance from a 70/30 EAA/NEAA (Whey) target amino acid profile of 0.0636. This increase in distance is due to a reduced match between the EAA/CEAA distributions. In particular, the EAA/CEAA distribution of this polypeptide is a far better match to the 60/40 EAA/NEAA (Whey) distribution (0.018) than the 70/30 EAA/NEAA (Whey) (0.039). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

Example 4

Naturally Occurring Proteins Ranked by PDCAAS Score

In this example the PDCAAS Score was used to rank proteins identified in the SwissProt database using the approach of Example 1. The 1000 proteins from the analysis with the highest PDCAAS scores are included in the Sequence Listing. The 100 proteins from the analysis with the highest PDCAAS scores were identified and are presented in Table 9. In Table 9A the proteins are identified by UniProtID number in the first column of the table. The second column indicates whether the protein contains every essential amino acid (1) or not (0). The third and fourth columns present the weight fraction of essential amino acids (EAA), and the total of non-essential and conditionally-essential amino acids (i.e., including C and Y) (NEAA+CEAA), respectively. The fifth column presents the PDCAAS score for each protein. The PDCAAS scores of the full set of 1000 identified proteins range from 1.92 to 1.57. It is noteworthy that the upper bound of this PDCAAS range is less than the lower bound of the PDCAAS range of the fragments analyzed in Example 2. Additionally, the average EAA percentage for the set of 1000 full length proteins in this list, 0.51, is smaller than the average EAA percentage of the fragments presented in Examples 2, 0.63. Together, these results suggest that one can find far more fragments with high PDCAAS scores compared to full length proteins, due in part to the fact that one can obtain higher EAA fractions, which dictate the theoretical maximum PDCAAS score. Furthermore, this intimates that the majority of natural proteins are not optimized for human nutritional needs.

For the set of proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated and are presented in Table 9B.

FIGS. 9-12 present an analysis of the essential amino acid content of four of the identified proteins that have among the highest PDCAAS scores.

Figure 9:
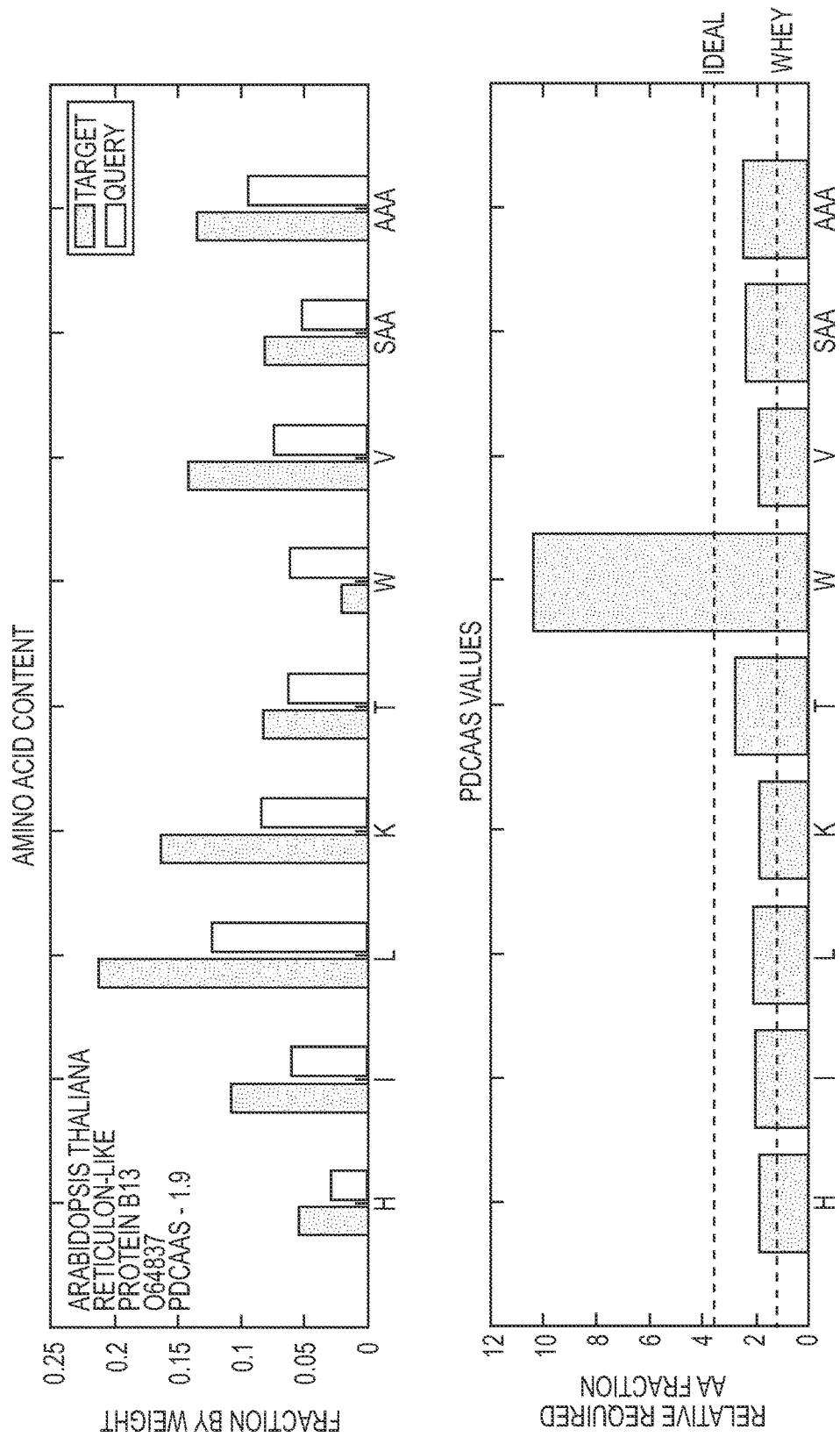
FIG. 9 shows the essential amino acid content of the *Arabidopsis thaliana* reticulon-like protein B13 (UniProt O64837) (SEQ ID NO: 428), which has a PDCAAS score of 1.9. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

The essential amino acid content of the *Arabidopsis thaliana* reticulon-like protein B13 (UniProt O64837) (SEQ ID NO: 428) is presented in FIG. 9. That protein has a PCDAAS value of 1.92. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein.

Figure 10:
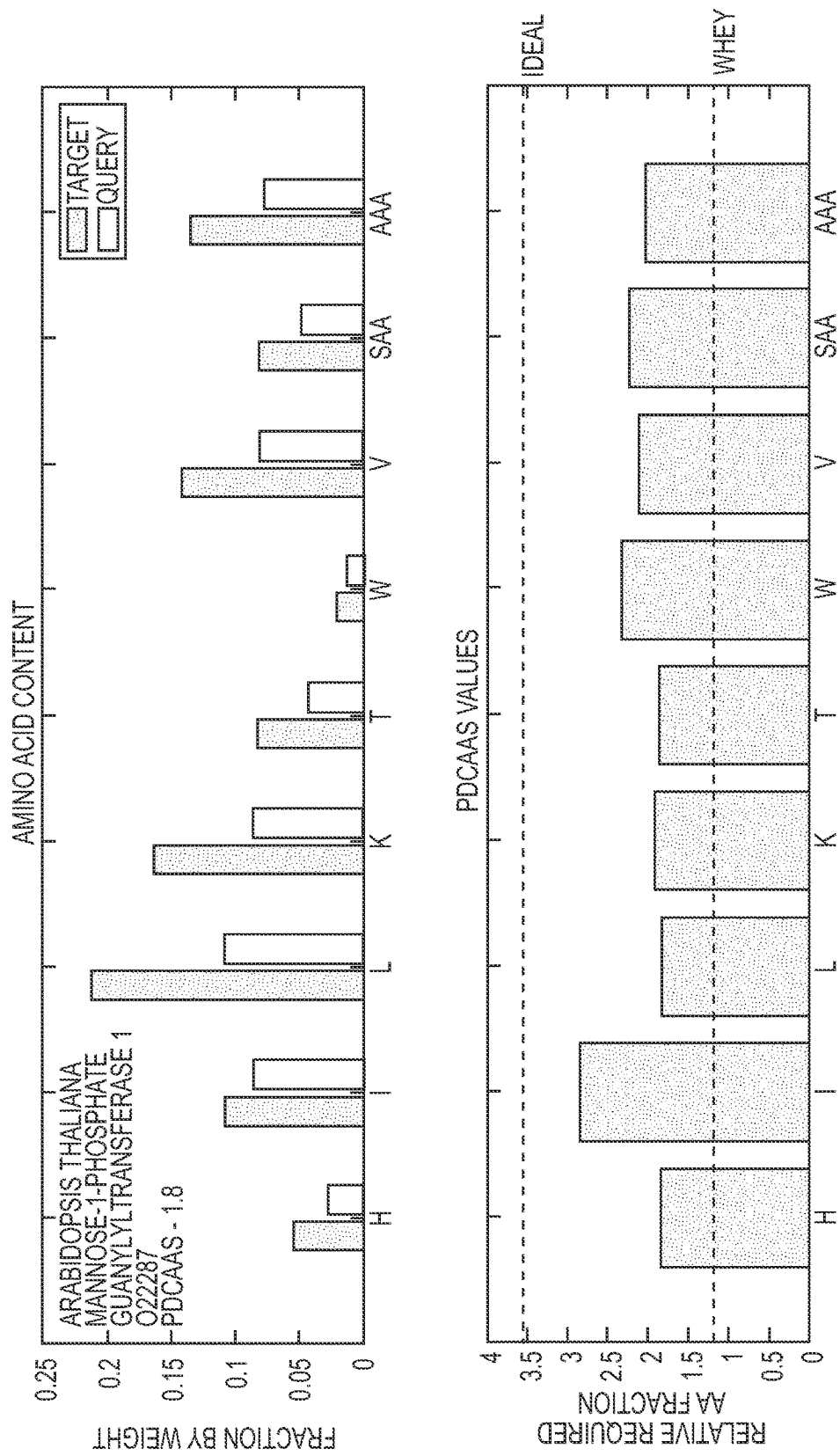
FIG. 10 shows the essential amino acid content of the *Arabidopsis thaliana* mannose-1-phosphate guanylyltransferase 1 protein (UniProt O22287) (SEQ ID NO: 257), which has a PDCAAS score of 1.8. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

The essential amino acid content of the *Arabidopsis thaliana* mannose-1-phosphate guanylyltransferase 1 protein (UniProt O22287) (SEQ ID NO: 257) is presented in FIG. 10. That protein has a PCDAAS value of 1.84. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein.

Figure 11:
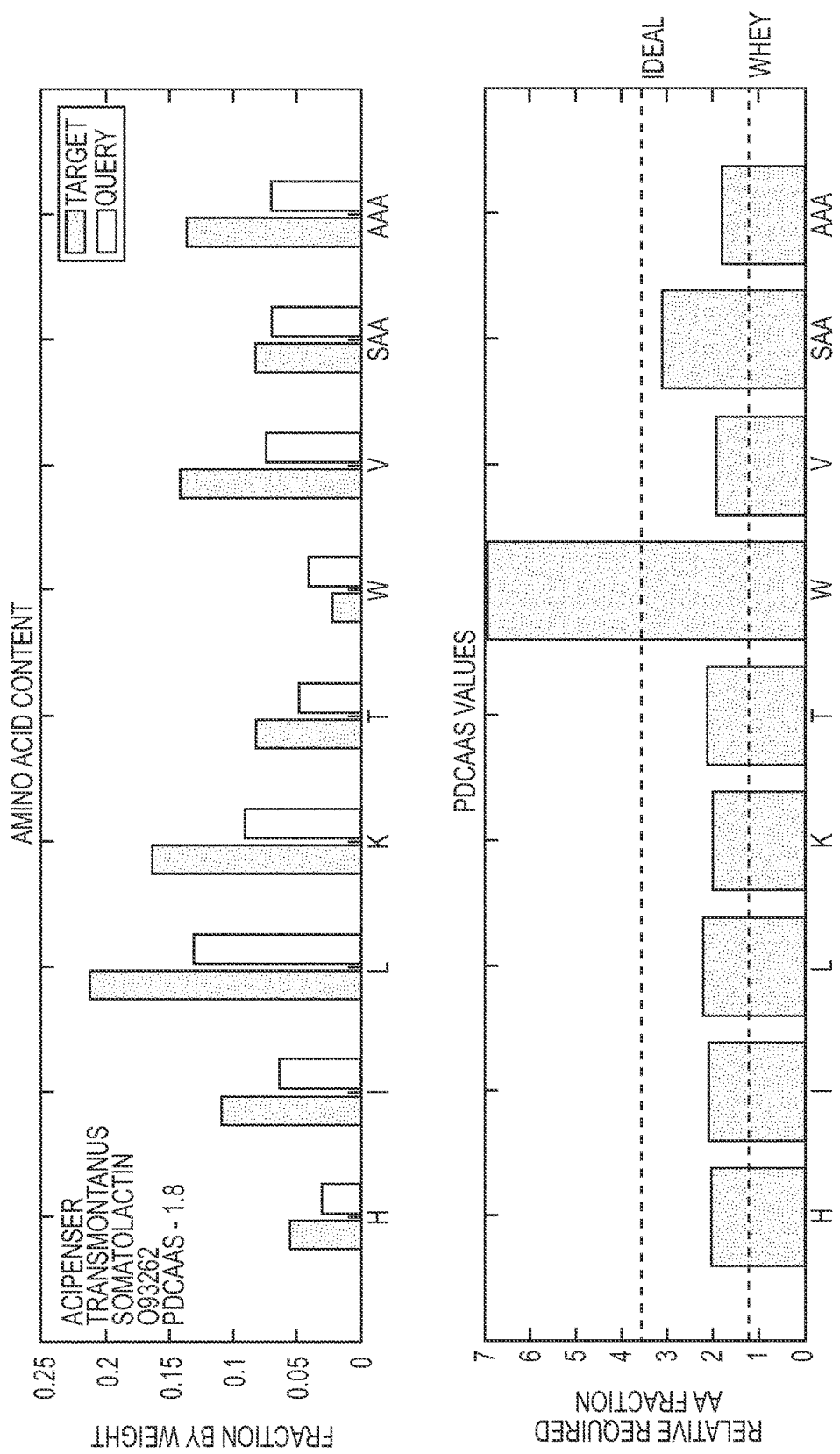
FIG. 11 shows the essential amino acid content of the *Acipenser transmontanus* somatolactin protein (UniProt O93262) (SEQ ID NO: 524), which has a PDCAAS score of 1.8. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

The essential amino acid content of the *Acipenser transmontanus* somatolactin protein (UniProt O93262) (SEQ ID NO: 524) is presented in FIG. 11. That protein has a PCDAAS value of 1.82. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein.

Figure 12:
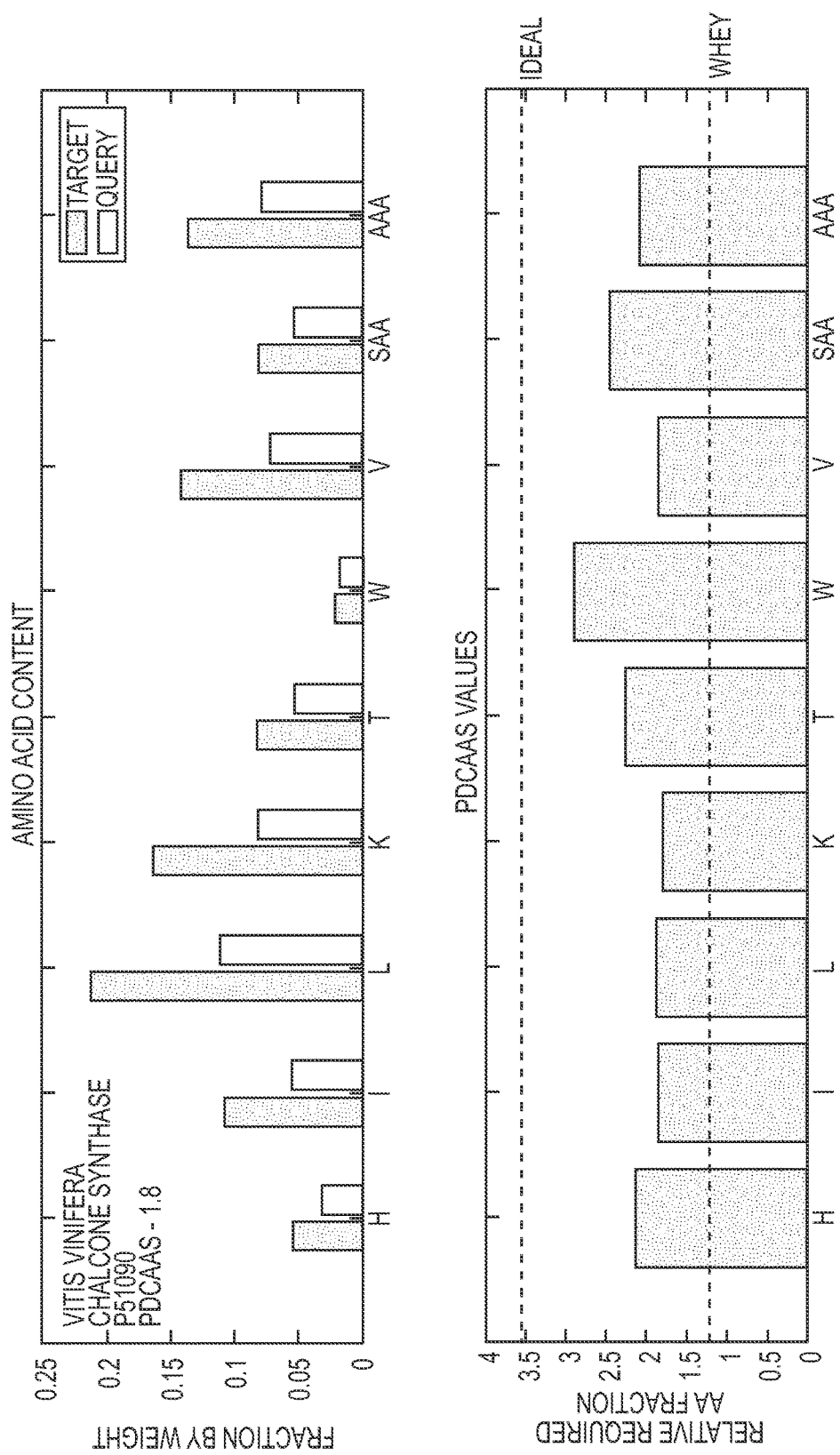
FIG. 12 shows the essential amino acid content of the *Vitis vinifera* chalcone synthase protein (UniProt P51090) (SEQ ID NO: 1391), which has a PDCAAS score of 1.7. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 (labeled "Ideal") and for whey protein.

The essential amino acid content of the *Vitis vinifera* chalcone synthase protein (UniProt P51090) (SEQ ID NO: 1391) is presented in FIG. 12. That protein has a PCDAAS value of 1.80. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 3.6 (black bars). The bottom panel presents the relative required amino acid fraction by weight of each type/category of essential amino acid that is provided by the fragment. For reference the hatched lines provide the corresponding values for a protein having a PCDAAS score of 3.6 and for whey protein.

TABLE 9A

| SeqIDNo | UniProtID | EAA Complete | [EAA] | [NEAA] | PDCAAS |
|---|---|---|---|---|---|
| 428 | O64837 | 1 | 0.61 | 0.39 | 1.92 |
| 257 | O22287 | 1 | 0.53 | 0.47 | 1.84 |
| 524 | O93262 | 1 | 0.55 | 0.45 | 1.82 |
| 1391 | P51090 | 1 | 0.50 | 0.50 | 1.80 |
| 2475 | Q58DC7 | 1 | 0.53 | 0.47 | 1.79 |
| 3986 | Q9M1T7 | 1 | 0.53 | 0.47 | 1.79 |
| 2343 | Q43609 | 1 | 0.52 | 0.48 | 1.79 |
| 451 | O74366 | 1 | 0.51 | 0.49 | 1.79 |
| 1184 | P38242 | 1 | 0.59 | 0.41 | 1.79 |
| 1834 | Q08959 | 1 | 0.62 | 0.38 | 1.78 |
| 1914 | Q0WRB0 | 1 | 0.54 | 0.46 | 1.78 |
| 2215 | Q3EBI7 | 1 | 0.50 | 0.50 | 1.78 |
| 2714 | Q5ZL79 | 1 | 0.51 | 0.49 | 1.78 |
| 338 | O48706 | 1 | 0.51 | 0.49 | 1.78 |
| 1771 | Q04516 | 1 | 0.53 | 0.47 | 1.77 |
| 3607 | Q96514 | 1 | 0.56 | 0.44 | 1.76 |
| 577 | P00812 | 1 | 0.49 | 0.51 | 1.76 |
| 2207 | Q3E8L3 | 1 | 0.55 | 0.45 | 1.75 |
| 2218 | Q3EBI7-2 | 1 | 0.51 | 0.49 | 1.75 |
| 362 | O49859 | 1 | 0.54 | 0.46 | 1.75 |
| 1487 | P58050 | 1 | 0.55 | 0.45 | 1.75 |
| 3544 | Q941T9 | 1 | 0.54 | 0.46 | 1.74 |
| 3786 | Q9FE17 | 1 | 0.50 | 0.50 | 1.74 |
| 1739 | Q00763 | 1 | 0.54 | 0.46 | 1.73 |
| 776 | P11251 | 1 | 0.56 | 0.44 | 1.73 |
| 2009 | Q1PE39 | 1 | 0.51 | 0.49 | 1.73 |
| 4233 | Q9UT62 | 1 | 0.60 | 0.40 | 1.73 |
| 935 | P21872 | 1 | 0.49 | 0.51 | 1.73 |
| 1262 | P42734-2 | 1 | 0.51 | 0.49 | 1.73 |
| 1763 | Q02774 | 1 | 0.54 | 0.46 | 1.73 |
| 4161 | Q9SUP0 | 1 | 0.64 | 0.36 | 1.73 |
| 255 | O22046 | 1 | 0.49 | 0.51 | 1.73 |
| 258 | O22652 | 1 | 0.50 | 0.50 | 1.73 |
| 1705 | P93834 | 1 | 0.51 | 0.49 | 1.72 |
| 361 | O49696-3 | 1 | 0.55 | 0.45 | 1.72 |
| 1522 | P62597 | 1 | 0.50 | 0.50 | 1.72 |
| 4393 | Q9ZU07 | 1 | 0.54 | 0.46 | 1.72 |
| 473 | O80580 | 1 | 0.61 | 0.39 | 1.72 |
| 3815 | Q9FKR3 | 1 | 0.52 | 0.48 | 1.72 |
| 2339 | Q43188 | 1 | 0.50 | 0.50 | 1.72 |
| 1843 | Q08D83-2 | 1 | 0.54 | 0.46 | 1.72 |
| 2338 | Q43163 | 1 | 0.50 | 0.50 | 1.72 |
| 966 | P23418 | 1 | 0.50 | 0.50 | 1.72 |
| 2319 | Q41436 | 1 | 0.50 | 0.50 | 1.72 |
| 4314 | Q9XGW0 | 1 | 0.53 | 0.47 | 1.72 |
| 2244 | Q3T099 | 1 | 0.51 | 0.49 | 1.72 |
| 407 | O59667 | 1 | 0.49 | 0.51 | 1.72 |
| 3107 | Q7YQE5 | 1 | 0.60 | 0.40 | 1.71 |
| 4313 | Q9XGV9 | 1 | 0.53 | 0.47 | 1.71 |
| 4170 | Q9SVQ1 | 1 | 0.51 | 0.49 | 1.71 |
| 1893 | Q0V7T5-2 | 1 | 0.52 | 0.48 | 1.71 |
| 4320 | Q9XJ57 | 1 | 0.50 | 0.50 | 1.71 |
| 3297 | Q8GWI2 | 1 | 0.54 | 0.46 | 1.71 |
| 4130 | Q9SIX1 | 1 | 0.51 | 0.49 | 1.71 |
| 136 | B3VKQ2 | 1 | 0.48 | 0.52 | 1.71 |
| 3838 | Q9FW44 | 1 | 0.52 | 0.48 | 1.71 |
| 844 | P15122 | 1 | 0.50 | 0.50 | 1.71 |
| 3812 | Q9FJK7 | 1 | 0.54 | 0.46 | 1.70 |
| 1117 | P33333 | 1 | 0.55 | 0.45 | 1.70 |
| 3306 | Q8H1D3 | 1 | 0.48 | 0.52 | 1.70 |
| 4225 | Q9US20 | 1 | 0.53 | 0.47 | 1.70 |
| 3366 | Q8LG50 | 1 | 0.54 | 0.46 | 1.70 |
| 3019 | Q6Z9A3 | 1 | 0.54 | 0.46 | 1.69 |
| 4394 | Q9ZU29 | 1 | 0.50 | 0.50 | 1.69 |
| 2123 | Q2KJ64 | 1 | 0.51 | 0.49 | 1.69 |
| 3797 | Q9FH66 | 1 | 0.53 | 0.47 | 1.69 |
| 1143 | P35181 | 1 | 0.55 | 0.45 | 1.69 |
| 2242 | Q3SZJ4 | 1 | 0.53 | 0.47 | 1.69 |
| 2251 | Q3T148 | 1 | 0.50 | 0.50 | 1.69 |
| 1446 | P53780-2 | 1 | 0.49 | 0.51 | 1.69 |
| 4119 | Q9SEK3 | 1 | 0.49 | 0.51 | 1.69 |
| 4105 | Q9SAG4 | 1 | 0.52 | 0.48 | 1.69 |
| 4197 | Q9SZK1 | 1 | 0.52 | 0.48 | 1.69 |
| 2247 | Q3T0M9 | 1 | 0.55 | 0.45 | 1.69 |
| 2208 | Q3E9C3-2 | 1 | 0.53 | 0.47 | 1.69 |
| 1123 | P34246 | 1 | 0.50 | 0.50 | 1.68 |
| 2122 | Q2KJ53 | 1 | 0.49 | 0.51 | 1.68 |
| 3947 | Q9LUL5 | 1 | 0.52 | 0.48 | 1.68 |
| 2798 | Q65AC2 | 1 | 0.54 | 0.46 | 1.68 |
| 1639 | P80276 | 1 | 0.49 | 0.51 | 1.68 |
| 3294 | Q8GW80 | 1 | 0.50 | 0.50 | 1.68 |
| 2518 | Q5E9H9 | 1 | 0.52 | 0.48 | 1.68 |
| 2180 | Q38860 | 1 | 0.51 | 0.49 | 1.68 |
| 581 | P00937 | 1 | 0.49 | 0.51 | 1.68 |
| 4154 | Q9SRE4 | 1 | 0.59 | 0.41 | 1.68 |
| 412 | O60053 | 1 | 0.50 | 0.50 | 1.68 |
| 3161 | Q84JH5 | 1 | 0.53 | 0.47 | 1.68 |
| 467 | O77480 | 1 | 0.47 | 0.53 | 1.68 |
| 1076 | P30918 | 1 | 0.64 | 0.31 | 1.57 |
| 2310 | Q3ZC84 | 1 | 0.49 | 0.51 | 1.68 |
| 3960 | Q9LXN3-2 | 1 | 0.54 | 0.46 | 1.68 |
| 1871 | Q09914 | 1 | 0.49 | 0.51 | 1.67 |
| 2898 | Q6H501 | 1 | 0.57 | 0.43 | 1.67 |
| 2149 | Q2YDM2 | 1 | 0.51 | 0.49 | 1.67 |
| 1420 | P53101 | 1 | 0.50 | 0.50 | 1.67 |
| 1445 | P53780 | 1 | 0.49 | 0.51 | 1.67 |
| 413 | O60135 | 1 | 0.48 | 0.52 | 1.67 |
| 1890 | Q0V7T5 | 1 | 0.52 | 0.48 | 1.67 |
| 4321 | Q9XJ58 | 1 | 0.50 | 0.50 | 1.67 |
| 2163 | Q32LH7 | 1 | 0.51 | 0.49 | 1.67 |

TABLE 9B

| Seq ID No | SolvScore | AggScore | Allergenicity | Toxicity | Antinutricity | Human Homology |
|---|---|---|---|---|---|---|
| 428 | −20.21 | 0.69 | 0.33 | 0.00 | 0.22 | 0.24 |
| 257 | −19.04 | 0.52 | 0.32 | 0.00 | 0.19 | 0.62 |
| 524 | −21.14 | 0.53 | 0.33 | 0.19 | 0.17 | 0.27 |
| 1391 | −18.99 | 0.54 | 0.33 | 0.00 | 0.20 | 0.00 |
| 2475 | −20.15 | 0.52 | 0.30 | 0.00 | 0.00 | 0.76 |
| 3986 | −18.98 | 0.52 | 0.56 | 0.20 | 1.00 | 0.29 |
| 2343 | −17.21 | 0.54 | 0.32 | 0.00 | 0.21 | 0.24 |
| 451 | −18.29 | 0.53 | 0.31 | 0.00 | 0.00 | 0.35 |
| 1184 | −16.47 | 0.79 | 0.28 | 0.22 | 0.21 | 0.30 |
| 1834 | −19.79 | 0.62 | 0.31 | 0.00 | 0.00 | 0.22 |
| 1914 | −20.93 | 0.51 | 0.35 | 0.20 | 0.23 | 0.27 |

TABLE 9B-continued

| Seq ID No | SolvScore | AggScore | Allergenicity | Toxicity | Antinutricity | Human Homology |
|---|---|---|---|---|---|---|
| 2215 | −21.17 | 0.52 | 0.33 | 0.00 | 0.21 | 0.00 |
| 2714 | −18.88 | 0.56 | 0.33 | 0.00 | 0.20 | 0.55 |
| 338 | −20.01 | 0.47 | 0.55 | 0.00 | 1.00 | 0.30 |
| 1771 | −18.13 | 0.55 | 0.35 | 0.00 | 0.00 | 0.30 |
| 3607 | −19.85 | 0.59 | 0.33 | 0.00 | 0.21 | 0.29 |
| 577 | −18.25 | 0.48 | 0.33 | 0.00 | 0.22 | 0.42 |
| 2207 | −20.27 | 0.55 | 0.35 | 0.00 | 0.22 | 0.00 |
| 2218 | −20.09 | 0.55 | 0.31 | 0.21 | 0.21 | 0.00 |
| 362 | −18.81 | 0.56 | 0.35 | 0.00 | 0.22 | 0.25 |
| 1487 | −20.85 | 0.52 | 0.34 | 0.00 | 0.22 | 0.28 |
| 3544 | −19.07 | 0.56 | 0.33 | 0.00 | 0.21 | 0.60 |
| 3786 | −21.96 | 0.40 | 0.34 | 0.00 | 0.22 | 0.35 |
| 1739 | −18.25 | 0.53 | 0.34 | 0.00 | 0.21 | 0.24 |
| 776 | −16.18 | 0.60 | 0.33 | 0.23 | 0.23 | 0.57 |
| 2009 | −21.15 | 0.53 | 0.33 | 0.00 | 0.22 | 0.23 |
| 4233 | −18.29 | 0.78 | 0.27 | 0.00 | 0.24 | 0.00 |
| 935 | −17.64 | 0.56 | 0.35 | 0.22 | 0.21 | 0.74 |
| 1262 | −16.24 | 0.58 | 0.43 | 0.00 | 0.21 | 0.27 |
| 1763 | −16.09 | 0.83 | 0.32 | 0.20 | 0.21 | 0.00 |
| 4161 | −11.99 | 1.15 | 0.32 | 0.00 | 0.21 | 0.00 |
| 255 | −19.12 | 0.50 | 0.33 | 0.00 | 0.21 | 0.00 |
| 258 | −19.92 | 0.50 | 0.34 | 0.00 | 0.23 | 0.00 |
| 1705 | −19.82 | 0.57 | 0.33 | 0.21 | 0.21 | 0.36 |
| 361 | −17.63 | 0.82 | 0.31 | 0.00 | 0.00 | 0.00 |
| 1522 | −19.40 | 0.39 | 0.32 | 0.00 | 0.21 | 0.49 |
| 4393 | −20.32 | 0.52 | 0.33 | 0.18 | 0.21 | 0.28 |
| 473 | −16.54 | 0.78 | 0.32 | 0.00 | 0.22 | 0.00 |
| 3815 | −20.76 | 0.45 | 0.36 | 0.00 | 0.20 | 0.20 |
| 2339 | −18.85 | 0.49 | 0.34 | 0.00 | 0.21 | 0.00 |
| 1843 | −14.34 | 0.85 | 0.32 | 0.22 | 0.24 | 0.96 |
| 2338 | −19.13 | 0.52 | 0.33 | 0.19 | 0.21 | 0.00 |
| 966 | −19.07 | 0.53 | 0.32 | 0.20 | 0.21 | 0.00 |
| 2319 | −18.97 | 0.53 | 0.33 | 0.00 | 0.21 | 0.00 |
| 4314 | −17.75 | 0.50 | 0.32 | 0.00 | 0.21 | 0.24 |
| 2244 | −20.12 | 0.45 | 0.31 | 0.23 | 0.20 | 0.89 |
| 407 | −21.22 | 0.44 | 0.33 | 0.22 | 0.21 | 0.00 |
| 3107 | −14.14 | 0.65 | 0.30 | 0.20 | 0.22 | 0.40 |
| 4313 | −17.88 | 0.51 | 0.33 | 0.00 | 0.20 | 0.24 |
| 4170 | −19.83 | 0.46 | 0.31 | 0.00 | 0.22 | 0.26 |
| 1893 | −18.40 | 0.58 | 0.46 | 0.00 | 0.20 | 0.29 |
| 4320 | −19.20 | 0.49 | 0.33 | 0.19 | 0.22 | 0.00 |
| 3297 | −19.91 | 0.49 | 0.33 | 0.21 | 0.22 | 0.21 |
| 4130 | −18.00 | 0.51 | 0.33 | 0.19 | 0.20 | 0.00 |
| 136 | −17.63 | 0.46 | 0.34 | 0.19 | 0.20 | 0.96 |
| 3838 | −22.41 | 0.48 | 0.34 | 0.00 | 0.21 | 0.00 |
| 844 | −19.96 | 0.38 | 0.32 | 0.00 | 0.00 | 0.89 |
| 3812 | −21.57 | 0.48 | 0.31 | 0.22 | 0.00 | 0.39 |
| 1117 | −17.54 | 0.59 | 0.35 | 0.00 | 0.21 | 0.28 |
| 3306 | −23.23 | 0.40 | 0.35 | 0.20 | 0.21 | 0.00 |
| 4225 | −17.22 | 0.69 | 0.30 | 0.20 | 0.21 | 0.31 |
| 3366 | −16.91 | 0.71 | 0.32 | 0.00 | 0.23 | 0.33 |
| 3019 | −19.20 | 0.55 | 0.32 | 0.00 | 0.21 | 0.60 |
| 4394 | −21.05 | 0.45 | 0.33 | 0.20 | 0.21 | 0.19 |
| 2123 | −20.08 | 0.43 | 0.33 | 0.00 | 0.20 | 0.91 |
| 3797 | −19.97 | 0.52 | 0.33 | 0.21 | 0.21 | 0.26 |
| 1143 | −22.02 | 0.48 | 0.32 | 0.22 | 0.00 | 0.54 |
| 2242 | −18.24 | 0.53 | 0.36 | 0.00 | 0.24 | 0.80 |
| 2251 | −22.36 | 0.50 | 0.31 | 0.00 | 0.20 | 1.00 |
| 1446 | −18.31 | 0.48 | 0.33 | 0.00 | 0.22 | 0.37 |
| 4119 | −20.69 | 0.52 | 0.33 | 0.22 | 0.22 | 0.37 |
| 4105 | −19.69 | 0.50 | 0.34 | 0.00 | 0.21 | 0.00 |
| 4197 | −18.54 | 0.56 | 0.35 | 0.00 | 0.21 | 0.00 |
| 2247 | −20.96 | 0.45 | 0.31 | 0.00 | 0.21 | 1.00 |
| 2208 | −20.17 | 0.60 | 0.33 | 0.00 | 0.00 | 0.27 |
| 1123 | −19.77 | 0.42 | 0.31 | 0.00 | 0.00 | 0.00 |
| 2122 | −18.77 | 0.52 | 0.33 | 0.00 | 0.23 | 0.96 |
| 3947 | −19.63 | 0.48 | 0.32 | 0.00 | 0.20 | 0.00 |
| 2798 | −15.64 | 0.77 | 0.33 | 0.00 | 0.20 | 0.89 |
| 1639 | −21.12 | 0.38 | 0.32 | 0.00 | 0.20 | 0.87 |
| 3294 | −19.60 | 0.45 | 0.34 | 0.18 | 0.21 | 0.00 |
| 2518 | −18.85 | 0.55 | 0.34 | 0.00 | 0.00 | 0.85 |
| 2180 | −17.85 | 0.55 | 0.32 | 0.00 | 0.20 | 0.00 |
| 581 | −19.17 | 0.46 | 0.31 | 0.21 | 0.22 | 0.22 |
| 4154 | −12.89 | 0.92 | 0.33 | 0.00 | 0.19 | 0.24 |
| 412 | −18.68 | 0.41 | 0.34 | 0.00 | 0.21 | 0.00 |
| 3161 | −18.80 | 0.58 | 0.33 | 0.00 | 0.22 | 0.61 |
| 467 | −18.33 | 0.45 | 0.32 | 0.00 | 0.21 | 0.86 |
| 1076 | −6.37 | 0.82 | 0.17 | 0.00 | 0.35 | 0.47 |
| 2310 | −21.15 | 0.42 | 0.32 | 0.00 | 0.23 | 0.91 |
| 3960 | −18.32 | 0.48 | 0.34 | 0.00 | 0.22 | 0.28 |
| 1871 | −22.40 | 0.53 | 0.30 | 0.00 | 0.00 | 0.67 |
| 2898 | −14.96 | 0.77 | 0.35 | 0.00 | 0.21 | 0.00 |
| 2149 | −19.92 | 0.43 | 0.31 | 0.00 | 0.21 | 0.97 |
| 1420 | −18.87 | 0.46 | 0.34 | 0.20 | 0.21 | 0.31 |
| 1445 | −18.10 | 0.46 | 0.31 | 0.00 | 0.22 | 0.36 |
| 413 | −20.75 | 0.40 | 0.33 | 0.00 | 0.21 | 0.35 |
| 1890 | −17.86 | 0.62 | 0.46 | 0.00 | 0.21 | 0.27 |
| 4321 | −19.47 | 0.50 | 0.33 | 0.00 | 0.21 | 0.00 |
| 2163 | −21.02 | 0.40 | 0.31 | 0.21 | 0.21 | 0.88 |

Example 5

Naturally Occurring Proteins Ranked by Euclidian Distance from a 60/40 EAA/NEAA Profile and by Eudlidian Distance from a 70/30 EAA/NEAA Profile In this example the Euclidian distance from a 70/30 EAA/NEAA (Whey) target amino acid profile and the Euclidian distance from a 60/40 EAA/NEAA (Whey) target amino acid profile were used to rank proteins identified in the SwissProt database using the approach of Example 1. After proteins were identified in this way the PDCAAS of each protein was also determined. The 1000 proteins from the analysis with the smallest Euclidian distance from a 60/40 EAA/NEAA (Whey) target amino acid profile are included in the Sequence Listing. The 100 proteins from the analysis with the smallest Euclidian distance from a 60/40 EAA/NEAA (Whey) target amino acid profile are presented in Table 10. The 1000 proteins from the analysis with the smallest Euclidian distance from a 70/30 EAA/NEAA (Whey) target amino acid profile are included in the Sequence Listing. The 100 proteins from the analysis with the smallest Euclidian distance from a 70/30 EAA/NEAA (Whey) target amino acid profile are presented in Table 11. In Tables 10A and 11A the proteins were first ranked by PDCAAS score (to the nearest tenth) and then ranked by Euclidian distance from the target profile. The proteins are identified by UniProtID number in the first column of the tables. The second column indicates whether the fragment contains every essential amino acid (1) or not (0). The third and fourth columns present the weight fraction of essential amino acids (EAA), and the total of non-essential and conditionally-essential amino acids (i.e., including C and Y) (NEAA+CEAA), respectively. The fifth column presents the PDCAAS score for each protein. The seventh column presents the distance from a 60/40 or 70/30 EAA/NEAA (Whey) target amino acid profile for each protein. The Euclidian distance from a 60/40 EAA/NEAA (Whey) target amino acid profile of the 1000 fragments ranges from 0.04834 to 0.0716. The Euclidian distance from a 70/30 EAA/NEAA (Whey) target amino acid profile of the fragments ranges from 0.0590 to 0.0936.

For each set of 100 proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated and are presented in Tables 10B and 11B.

TABLE 10A

| SeqIDNo | UniProtID | EAA Complete | [EAA] | [NEAA] | PDCAAS | Dist. Target |
|---|---|---|---|---|---|---|
| 1391 | P51090 | 1 | 0.50 | 0.50 | 1.80 | 0.0593 |
| 2343 | Q43609 | 1 | 0.52 | 0.48 | 1.79 | 0.0610 |
| 2714 | Q5ZL79 | 1 | 0.51 | 0.49 | 1.78 | 0.0626 |
| 362 | O49859 | 1 | 0.54 | 0.46 | 1.75 | 0.0639 |
| 577 | P00812 | 1 | 0.49 | 0.51 | 1.76 | 0.0652 |
| 935 | P21872 | 1 | 0.49 | 0.51 | 1.73 | 0.0549 |
| 4313 | Q9XGV9 | 1 | 0.53 | 0.47 | 1.71 | 0.0561 |
| 4320 | Q9XJ57 | 1 | 0.50 | 0.50 | 1.71 | 0.0596 |
| 2242 | Q3SZJ4 | 1 | 0.53 | 0.47 | 1.69 | 0.0624 |
| 255 | O22046 | 1 | 0.49 | 0.51 | 1.73 | 0.0624 |
| 4314 | Q9XGW0 | 1 | 0.53 | 0.47 | 1.72 | 0.0629 |
| 2234 | Q3MHL4 | 1 | 0.50 | 0.50 | 1.65 | 0.0633 |
| 1362 | P49440 | 1 | 0.50 | 0.50 | 1.66 | 0.0646 |
| 2339 | Q43188 | 1 | 0.50 | 0.50 | 1.72 | 0.0647 |
| 2251 | Q3T148 | 1 | 0.50 | 0.50 | 1.69 | 0.0649 |
| 1739 | Q00763 | 1 | 0.54 | 0.46 | 1.73 | 0.0654 |
| 1380 | P51071 | 1 | 0.50 | 0.50 | 1.66 | 0.0656 |
| 256 | O22047 | 1 | 0.49 | 0.51 | 1.67 | 0.0659 |
| 844 | P15122 | 1 | 0.50 | 0.50 | 1.71 | 0.0659 |
| 3100 | Q7XRA1 | 1 | 0.50 | 0.50 | 1.65 | 0.0668 |
| 2338 | Q43163 | 1 | 0.50 | 0.50 | 1.72 | 0.0670 |
| 3998 | Q9MB33 | 1 | 0.50 | 0.50 | 1.67 | 0.0675 |
| 2319 | Q41436 | 1 | 0.50 | 0.50 | 1.72 | 0.0678 |
| 4000 | Q9MB37 | 1 | 0.50 | 0.50 | 1.67 | 0.0679 |
| 966 | P23418 | 1 | 0.50 | 0.50 | 1.72 | 0.0687 |
| 1839 | Q08975 | 1 | 0.47 | 0.53 | 1.66 | 0.0704 |
| 407 | O59667 | 1 | 0.49 | 0.51 | 1.72 | 0.0708 |
| 3507 | Q92093 | 1 | 0.49 | 0.51 | 1.67 | 0.0710 |
| 1871 | Q09914 | 1 | 0.49 | 0.51 | 1.67 | 0.0713 |
| 4321 | Q9XJ58 | 1 | 0.50 | 0.50 | 1.67 | 0.0715 |
| 2884 | Q6EE31 | 1 | 0.49 | 0.51 | 1.57 | 0.0579 |
| 4198 | Q9SZW4 | 1 | 0.50 | 0.50 | 1.56 | 0.0580 |
| 639 | P04161 | 1 | 0.48 | 0.52 | 1.59 | 0.0585 |
| 2796 | Q652P4 | 1 | 0.49 | 0.51 | 1.62 | 0.0592 |
| 544 | O94564 | 1 | 0.51 | 0.49 | 1.59 | 0.0592 |
| 2313 | Q3ZCI9 | 1 | 0.49 | 0.51 | 1.56 | 0.0600 |
| 221 | O13639 | 1 | 0.51 | 0.49 | 1.58 | 0.0616 |
| 2330 | Q42896 | 1 | 0.52 | 0.48 | 1.58 | 0.0617 |
| 1221 | P39954 | 1 | 0.50 | 0.50 | 1.60 | 0.0622 |
| 1046 | P28475 | 1 | 0.52 | 0.48 | 1.60 | 0.0626 |
| 2690 | Q5ZI67 | 1 | 0.49 | 0.51 | 1.63 | 0.0628 |
| 814 | P13491 | 1 | 0.55 | 0.45 | 1.56 | 0.0633 |
| 3813 | Q9FK25 | 1 | 0.53 | 0.47 | 1.60 | 0.0641 |
| 2324 | Q42586 | 1 | 0.52 | 0.48 | 1.59 | 0.0642 |
| 683 | P07246 | 1 | 0.51 | 0.49 | 1.55 | 0.0642 |
| 3929 | Q9LMU0 | 1 | 0.51 | 0.49 | 1.56 | 0.0645 |
| 3657 | Q9BEC7 | 1 | 0.51 | 0.49 | 1.56 | 0.0646 |
| 2112 | Q29RY4 | 1 | 0.51 | 0.49 | 1.55 | 0.0646 |
| 2495 | Q59A28 | 1 | 0.50 | 0.50 | 1.56 | 0.0651 |
| 3097 | Q7XJ81 | 1 | 0.51 | 0.49 | 1.58 | 0.0652 |
| 259 | O22711 | 1 | 0.55 | 0.45 | 1.56 | 0.0654 |
| 2183 | Q39069 | 1 | 0.49 | 0.51 | 1.58 | 0.0658 |
| 3540 | Q93WU3 | 1 | 0.54 | 0.46 | 1.57 | 0.0659 |
| 365 | O50008 | 1 | 0.48 | 0.52 | 1.61 | 0.0660 |
| 602 | P02103 | 1 | 0.58 | 0.42 | 1.62 | 0.0661 |
| 4004 | Q9MB41 | 1 | 0.49 | 0.51 | 1.60 | 0.0664 |
| 670 | P06169 | 1 | 0.51 | 0.49 | 1.57 | 0.0665 |
| 4001 | Q9MB38 | 1 | 0.49 | 0.51 | 1.60 | 0.0672 |
| 4003 | Q9MB40 | 1 | 0.49 | 0.51 | 1.56 | 0.0675 |
| 2701 | Q5ZJ64 | 1 | 0.51 | 0.49 | 1.59 | 0.0676 |
| 3923 | Q9LK36 | 1 | 0.50 | 0.50 | 1.55 | 0.0678 |
| 1678 | P87241 | 1 | 0.50 | 0.50 | 1.60 | 0.0681 |
| 266 | O23255 | 1 | 0.50 | 0.50 | 1.58 | 0.0684 |
| 232 | O14075 | 1 | 0.50 | 0.50 | 1.59 | 0.0685 |
| 1379 | P51070 | 1 | 0.50 | 0.50 | 1.60 | 0.0686 |
| 1740 | Q00775 | 1 | 0.51 | 0.49 | 1.64 | 0.0689 |
| 3539 | Q93WU2 | 1 | 0.54 | 0.46 | 1.62 | 0.0689 |
| 3999 | Q9MB36 | 1 | 0.49 | 0.51 | 1.55 | 0.0691 |
| 711 | P08566 | 1 | 0.50 | 0.50 | 1.60 | 0.0691 |
| 4155 | Q9SRZ4 | 1 | 0.55 | 0.45 | 1.57 | 0.0695 |
| 3872 | Q9HE04 | 1 | 0.51 | 0.49 | 1.63 | 0.0695 |
| 3403 | Q8RY79 | 1 | 0.48 | 0.52 | 1.57 | 0.0696 |

TABLE 10A-continued

| SeqIDNo | UniProtID | EAA Complete | [EAA] | [NEAA] | PDCAAS | Dist. Target |
|---|---|---|---|---|---|---|
| 224 | O13848 | 1 | 0.53 | 0.47 | 1.64 | 0.0699 |
| 114 | A8E657 | 1 | 0.48 | 0.52 | 1.62 | 0.0699 |
| 1095 | P31754 | 1 | 0.48 | 0.52 | 1.58 | 0.0704 |
| 1997 | Q1KYT0 | 1 | 0.48 | 0.52 | 1.55 | 0.0705 |
| 1072 | P30624 | 1 | 0.51 | 0.49 | 1.55 | 0.0706 |
| 1753 | Q01781 | 1 | 0.49 | 0.51 | 1.55 | 0.0711 |
| 1017 | P26690 | 1 | 0.50 | 0.50 | 1.57 | 0.0711 |
| 1176 | P37829 | 1 | 0.51 | 0.49 | 1.56 | 0.0712 |
| 928 | P21528 | 1 | 0.46 | 0.54 | 1.58 | 0.0716 |
| 479 | O80944-3 | 1 | 0.52 | 0.48 | 1.51 | 0.0590 |
| 478 | O80944-2 | 1 | 0.51 | 0.49 | 1.51 | 0.0611 |
| 233 | O14134 | 1 | 0.48 | 0.52 | 1.51 | 0.0618 |
| 1747 | Q01288 | 1 | 0.50 | 0.50 | 1.50 | 0.0636 |
| 703 | P07991 | 1 | 0.51 | 0.49 | 1.54 | 0.0639 |
| 1217 | P39676 | 1 | 0.51 | 0.49 | 1.55 | 0.0650 |
| 2527 | Q5F418 | 1 | 0.47 | 0.53 | 1.46 | 0.0650 |
| 537 | O94404 | 1 | 0.48 | 0.52 | 1.53 | 0.0652 |
| 1706 | P93848 | 1 | 0.55 | 0.45 | 1.55 | 0.0653 |
| 477 | O80944 | 1 | 0.52 | 0.48 | 1.47 | 0.0653 |
| 2496 | Q59A32 | 1 | 0.48 | 0.52 | 1.53 | 0.0665 |
| 4176 | Q9SWF5 | 1 | 0.51 | 0.49 | 1.55 | 0.0669 |
| 3315 | Q8HYR6 | 1 | 0.54 | 0.46 | 1.50 | 0.0672 |
| 2522 | Q5EA88 | 1 | 0.52 | 0.48 | 1.48 | 0.0673 |
| 4192 | Q9SYZ7 | 1 | 0.52 | 0.48 | 1.52 | 0.0675 |
| 254 | O22045 | 1 | 0.49 | 0.51 | 1.49 | 0.0680 |
| 565 | P00337 | 1 | 0.53 | 0.47 | 1.48 | 0.0682 |
| 2530 | Q5FJB3 | 1 | 0.51 | 0.49 | 1.22 | 0.0547 |
| 3830 | Q9FR35 | 1 | 0.52 | 0.48 | 0.96 | 0.0553 |

TABLE 10B

| Seq ID No | SolvScore | AggScore | Allergenicity | Toxicity | Antinutricity | Human Homology |
|---|---|---|---|---|---|---|
| 1391 | −18.99 | 0.54 | 0.33 | 0.00 | 0.20 | 0.00 |
| 2343 | −17.21 | 0.54 | 0.32 | 0.00 | 0.21 | 0.24 |
| 2714 | −18.88 | 0.56 | 0.33 | 0.00 | 0.20 | 0.55 |
| 362 | −18.81 | 0.56 | 0.35 | 0.00 | 0.22 | 0.25 |
| 577 | −18.25 | 0.48 | 0.33 | 0.00 | 0.22 | 0.42 |
| 935 | −17.64 | 0.56 | 0.35 | 0.22 | 0.21 | 0.74 |
| 4313 | −17.88 | 0.51 | 0.33 | 0.00 | 0.20 | 0.24 |
| 4320 | −19.20 | 0.49 | 0.33 | 0.19 | 0.22 | 0.00 |
| 2242 | −18.24 | 0.53 | 0.36 | 0.00 | 0.24 | 0.80 |
| 255 | −19.12 | 0.50 | 0.33 | 0.00 | 0.21 | 0.00 |
| 4314 | −17.75 | 0.50 | 0.32 | 0.00 | 0.21 | 0.24 |
| 2234 | −19.29 | 0.45 | 0.32 | 0.19 | 0.21 | 0.97 |
| 1362 | −18.79 | 0.52 | 0.33 | 0.22 | 0.19 | 0.00 |
| 2339 | −18.85 | 0.49 | 0.34 | 0.00 | 0.21 | 0.00 |
| 2251 | −22.36 | 0.50 | 0.31 | 0.00 | 0.20 | 1.00 |
| 1739 | −18.25 | 0.53 | 0.34 | 0.00 | 0.21 | 0.24 |
| 1380 | −18.48 | 0.51 | 0.33 | 0.00 | 0.21 | 0.00 |
| 256 | −19.07 | 0.50 | 0.32 | 0.00 | 0.21 | 0.00 |
| 844 | −19.96 | 0.38 | 0.32 | 0.00 | 0.00 | 0.89 |
| 3100 | −17.83 | 0.44 | 0.32 | 0.20 | 0.21 | 0.00 |
| 2338 | −19.13 | 0.52 | 0.33 | 0.19 | 0.21 | 0.00 |
| 3998 | −17.96 | 0.51 | 0.34 | 0.00 | 0.20 | 0.00 |
| 2319 | −18.97 | 0.53 | 0.33 | 0.00 | 0.21 | 0.00 |
| 4000 | −18.15 | 0.50 | 0.34 | 0.19 | 0.20 | 0.00 |
| 966 | −19.07 | 0.53 | 0.32 | 0.20 | 0.21 | 0.00 |
| 1839 | −19.71 | 0.41 | 0.33 | 0.00 | 0.21 | 0.00 |
| 407 | −21.22 | 0.44 | 0.33 | 0.22 | 0.21 | 0.00 |
| 3507 | −18.40 | 0.50 | 0.58 | 0.19 | 0.19 | 0.19 |
| 1871 | −22.40 | 0.53 | 0.30 | 0.00 | 0.00 | 0.67 |
| 4321 | −19.47 | 0.50 | 0.33 | 0.00 | 0.21 | 0.00 |
| 2884 | −20.22 | 0.47 | 0.32 | 0.20 | 0.22 | 0.93 |
| 4198 | −18.06 | 0.63 | 0.33 | 0.19 | 0.20 | 0.25 |
| 639 | −19.93 | 0.57 | 0.31 | 0.24 | 0.24 | 0.34 |
| 2796 | −19.96 | 0.46 | 0.35 | 0.00 | 0.21 | 0.37 |
| 544 | −16.66 | 0.53 | 0.39 | 0.00 | 0.19 | 0.29 |
| 2313 | −20.38 | 0.47 | 0.33 | 0.00 | 0.21 | 0.98 |
| 221 | −19.46 | 0.51 | 0.32 | 0.20 | 0.22 | 0.77 |
| 2330 | −17.96 | 0.56 | 0.33 | 0.00 | 0.21 | 0.26 |
| 1221 | −18.95 | 0.51 | 0.36 | 0.00 | 0.21 | 0.70 |
| 1046 | −20.92 | 0.40 | 0.34 | 0.00 | 0.20 | 0.40 |
| 2690 | −18.40 | 0.48 | 0.34 | 0.00 | 0.20 | 0.75 |
| 814 | −18.58 | 0.57 | 0.33 | 0.00 | 0.21 | 0.94 |
| 3813 | −18.96 | 0.51 | 0.33 | 0.00 | 0.21 | 0.24 |
| 2324 | −18.96 | 0.58 | 0.35 | 0.00 | 0.22 | 0.54 |
| 683 | −18.18 | 0.46 | 0.86 | 0.00 | 0.20 | 0.25 |
| 3929 | −17.75 | 0.43 | 0.31 | 0.00 | 0.22 | 0.34 |
| 3657 | −17.48 | 0.55 | 0.34 | 0.00 | 0.21 | 0.92 |
| 2112 | −20.30 | 0.48 | 0.35 | 0.18 | 0.20 | 0.94 |
| 2495 | −20.70 | 0.49 | 0.31 | 0.00 | 0.24 | 0.94 |
| 3097 | −17.73 | 0.57 | 0.34 | 0.00 | 0.22 | 0.26 |
| 259 | −19.19 | 0.57 | 0.49 | 0.24 | 0.23 | 0.40 |
| 2183 | −20.81 | 0.47 | 0.32 | 0.00 | 0.21 | 0.33 |
| 3540 | −18.17 | 0.51 | 0.34 | 0.00 | 0.21 | 0.21 |
| 365 | −19.90 | 0.42 | 0.95 | 0.00 | 0.22 | 0.00 |
| 602 | −17.93 | 0.52 | 0.29 | 0.24 | 0.23 | 0.86 |
| 4004 | −17.83 | 0.52 | 0.34 | 0.00 | 0.20 | 0.00 |
| 670 | −16.92 | 0.48 | 0.33 | 0.00 | 0.22 | 0.22 |
| 4001 | −17.81 | 0.52 | 0.34 | 0.00 | 0.21 | 0.20 |
| 4003 | −17.78 | 0.51 | 0.34 | 0.20 | 0.22 | 0.00 |
| 2701 | −22.19 | 0.51 | 0.32 | 0.00 | 0.20 | 0.96 |
| 3923 | −19.50 | 0.50 | 0.33 | 0.20 | 0.21 | 0.55 |
| 1678 | −20.35 | 0.47 | 0.32 | 0.00 | 0.19 | 0.00 |
| 266 | −19.76 | 0.50 | 0.33 | 0.21 | 0.21 | 0.55 |
| 232 | −20.63 | 0.47 | 0.32 | 0.21 | 0.00 | 0.29 |
| 1379 | −18.20 | 0.51 | 0.33 | 0.00 | 0.22 | 0.00 |
| 1740 | −18.49 | 0.50 | 0.33 | 0.00 | 0.22 | 0.00 |
| 3539 | −18.39 | 0.50 | 0.32 | 0.00 | 0.21 | 0.22 |
| 3999 | −17.81 | 0.52 | 0.34 | 0.00 | 0.21 | 0.00 |
| 711 | −19.14 | 0.46 | 0.33 | 0.19 | 0.19 | 0.00 |
| 4155 | −19.10 | 0.57 | 0.49 | 0.24 | 0.23 | 0.40 |
| 3872 | −21.84 | 0.52 | 0.31 | 0.22 | 0.24 | 0.65 |
| 3403 | −18.35 | 0.51 | 0.35 | 0.00 | 0.22 | 0.48 |
| 224 | −20.40 | 0.40 | 0.31 | 0.00 | 0.00 | 0.33 |
| 114 | −18.77 | 0.44 | 0.34 | 0.00 | 0.20 | 0.90 |
| 1095 | −19.18 | 0.55 | 0.32 | 0.00 | 0.22 | 0.84 |
| 1997 | −20.83 | 0.43 | 0.99 | 0.21 | 0.22 | 0.97 |
| 1072 | −19.81 | 0.43 | 0.33 | 0.00 | 0.20 | 0.31 |
| 1753 | −20.01 | 0.48 | 0.32 | 0.00 | 0.21 | 0.56 |

TABLE 10B-continued

| Seq ID No | SolvScore | AggScore | Allergenicity | Toxicity | Antinutricity | Human Homology |
|---|---|---|---|---|---|---|
| 1017 | −19.84 | 0.41 | 0.31 | 0.22 | 0.00 | 0.39 |
| 1176 | −18.41 | 0.57 | 0.33 | 0.00 | 0.21 | 0.26 |
| 928 | −18.74 | 0.45 | 0.33 | 0.18 | 0.22 | 0.35 |
| 479 | −18.99 | 0.32 | 0.31 | 0.00 | 0.23 | 0.43 |
| 478 | −19.19 | 0.32 | 0.31 | 0.00 | 0.22 | 0.43 |
| 233 | −20.71 | 0.46 | 0.33 | 0.20 | 0.19 | 0.23 |
| 1747 | −19.27 | 0.51 | 0.33 | 0.19 | 0.21 | 0.00 |
| 703 | −17.28 | 0.56 | 0.31 | 0.00 | 0.21 | 0.52 |
| 1217 | −19.88 | 0.43 | 0.32 | 0.00 | 0.19 | 0.00 |
| 2527 | −20.93 | 0.52 | 0.36 | 0.00 | 0.20 | 0.97 |
| 537 | −17.12 | 0.48 | 0.33 | 0.00 | 0.21 | 0.32 |
| 1706 | −18.13 | 0.52 | 0.28 | 0.00 | 0.23 | 0.25 |
| 477 | −20.15 | 0.30 | 0.31 | 0.00 | 0.24 | 0.42 |
| 2496 | −18.27 | 0.53 | 0.36 | 0.20 | 0.22 | 0.88 |
| 4176 | −19.62 | 0.48 | 0.31 | 0.00 | 0.22 | 0.55 |
| 3315 | −18.36 | 0.60 | 0.33 | 0.23 | 0.00 | 0.87 |
| 2522 | −17.51 | 0.57 | 0.31 | 0.00 | 0.20 | 0.93 |
| 4192 | −22.14 | 0.51 | 0.33 | 0.00 | 0.00 | 0.20 |
| 254 | −18.06 | 0.51 | 0.34 | 0.00 | 0.22 | 0.00 |
| 565 | −17.65 | 0.58 | 0.31 | 0.00 | 0.18 | 0.90 |
| 2530 | −19.87 | 0.47 | 0.33 | 0.20 | 0.00 | 0.23 |
| 3830 | −18.09 | 0.52 | 0.46 | 0.00 | 0.00 | 0.43 |

TABLE 11A

| SeqIDNo | UniProtID | EAA Complete | [EAA] | [NEAA] | PDCAAS | Dist. Target |
|---|---|---|---|---|---|---|
| 1834 | Q08959 | 1 | 0.62 | 0.38 | 1.78 | 0.0829 |
| 362 | O49859 | 1 | 0.54 | 0.46 | 1.75 | 0.0830 |
| 2714 | Q5ZL79 | 1 | 0.51 | 0.49 | 1.78 | 0.0835 |
| 2343 | Q43609 | 1 | 0.52 | 0.48 | 1.79 | 0.0837 |
| 3607 | Q96514 | 1 | 0.56 | 0.44 | 1.76 | 0.0837 |
| 2207 | Q3E8L3 | 1 | 0.55 | 0.45 | 1.75 | 0.0861 |
| 1391 | P51090 | 1 | 0.50 | 0.50 | 1.80 | 0.0909 |
| 3986 | Q9M1T7 | 1 | 0.53 | 0.47 | 1.79 | 0.0915 |
| 1184 | P38242 | 1 | 0.59 | 0.41 | 1.79 | 0.0919 |
| 1914 | Q0WRB0 | 1 | 0.54 | 0.46 | 1.78 | 0.0926 |
| 577 | P00812 | 1 | 0.49 | 0.51 | 1.76 | 0.0929 |
| 4313 | Q9XGV9 | 1 | 0.53 | 0.47 | 1.71 | 0.0787 |
| 1117 | P33333 | 1 | 0.55 | 0.45 | 1.70 | 0.0809 |
| 2242 | Q3SZJ4 | 1 | 0.53 | 0.47 | 1.69 | 0.0824 |
| 473 | O80580 | 1 | 0.61 | 0.39 | 1.72 | 0.0829 |
| 1739 | Q00763 | 1 | 0.54 | 0.46 | 1.73 | 0.0838 |
| 4314 | Q9XGW0 | 1 | 0.53 | 0.47 | 1.72 | 0.0849 |
| 2798 | Q65AC2 | 1 | 0.54 | 0.46 | 1.68 | 0.0857 |
| 3960 | Q9LXN3-2 | 1 | 0.54 | 0.46 | 1.68 | 0.0885 |
| 844 | P15122 | 1 | 0.50 | 0.50 | 1.71 | 0.0886 |
| 3297 | Q8GWI2 | 1 | 0.54 | 0.46 | 1.71 | 0.0886 |
| 361 | O49696-3 | 1 | 0.55 | 0.45 | 1.72 | 0.0886 |
| 4233 | Q9UT62 | 1 | 0.60 | 0.40 | 1.73 | 0.0889 |
| 935 | P21872 | 1 | 0.49 | 0.51 | 1.73 | 0.0898 |
| 1763 | Q02774 | 1 | 0.54 | 0.46 | 1.73 | 0.0904 |
| 2251 | Q3T148 | 1 | 0.50 | 0.50 | 1.69 | 0.0905 |
| 4320 | Q9XJ57 | 1 | 0.50 | 0.50 | 1.71 | 0.0906 |
| 2234 | Q3MHL4 | 1 | 0.50 | 0.50 | 1.65 | 0.0914 |
| 1843 | Q08D83-2 | 1 | 0.54 | 0.46 | 1.72 | 0.0915 |
| 3100 | Q7XRA1 | 1 | 0.50 | 0.50 | 1.65 | 0.0916 |
| 4161 | Q9SUP0 | 1 | 0.64 | 0.36 | 1.73 | 0.0929 |
| 1362 | P49440 | 1 | 0.50 | 0.50 | 1.66 | 0.0929 |
| 1890 | Q0V7T5 | 1 | 0.52 | 0.48 | 1.67 | 0.0936 |
| 4386 | Q9ZQR8-2 | 1 | 0.57 | 0.43 | 1.56 | 0.0768 |
| 602 | P02103 | 1 | 0.58 | 0.42 | 1.62 | 0.0799 |
| 814 | P13491 | 1 | 0.55 | 0.45 | 1.56 | 0.0804 |
| 1046 | P28475 | 1 | 0.52 | 0.48 | 1.60 | 0.0806 |
| 3959 | Q9LXN3 | 1 | 0.55 | 0.45 | 1.63 | 0.0842 |
| 3813 | Q9FK25 | 1 | 0.53 | 0.47 | 1.60 | 0.0847 |
| 259 | O22711 | 1 | 0.55 | 0.45 | 1.56 | 0.0865 |
| 544 | O94564 | 1 | 0.51 | 0.49 | 1.59 | 0.0865 |
| 683 | P07246 | 1 | 0.51 | 0.49 | 1.55 | 0.0871 |
| 3872 | Q9HE04 | 1 | 0.51 | 0.49 | 1.63 | 0.0877 |
| 2324 | Q42586 | 1 | 0.52 | 0.48 | 1.59 | 0.0886 |
| 2796 | Q652P4 | 1 | 0.49 | 0.51 | 1.62 | 0.0887 |
| 4155 | Q9SRZ4 | 1 | 0.55 | 0.45 | 1.57 | 0.0890 |
| 2701 | Q5ZJ64 | 1 | 0.51 | 0.49 | 1.59 | 0.0891 |
| 1453 | P53970 | 1 | 0.54 | 0.46 | 1.56 | 0.0895 |
| 224 | O13848 | 1 | 0.53 | 0.47 | 1.64 | 0.0899 |
| 4198 | Q9SZW4 | 1 | 0.50 | 0.50 | 1.56 | 0.0900 |
| 3657 | Q9BEC7 | 1 | 0.51 | 0.49 | 1.56 | 0.0901 |
| 2183 | Q39069 | 1 | 0.49 | 0.51 | 1.58 | 0.0901 |
| 3665 | Q9C1X2 | 1 | 0.50 | 0.50 | 1.58 | 0.0902 |
| 356 | O49621 | 1 | 0.58 | 0.42 | 1.64 | 0.0902 |
| 2112 | Q29RY4 | 1 | 0.51 | 0.49 | 1.55 | 0.0905 |
| 1072 | P30624 | 1 | 0.51 | 0.49 | 1.55 | 0.0907 |

TABLE 11A-continued

| SeqIDNo | UniProtID | EAA Complete | [EAA] | [NEAA] | PDCAAS | Dist. Target |
|---|---|---|---|---|---|---|
| 1740 | Q00775 | 1 | 0.51 | 0.49 | 1.64 | 0.0910 |
| 2330 | Q42896 | 1 | 0.52 | 0.48 | 1.58 | 0.0912 |
| 1678 | P87241 | 1 | 0.50 | 0.50 | 1.60 | 0.0919 |
| 3539 | Q93WU2 | 1 | 0.54 | 0.46 | 1.62 | 0.0920 |
| 607 | P02112 | 1 | 0.56 | 0.44 | 1.58 | 0.0921 |
| 3453 | Q8VZI2 | 1 | 0.54 | 0.46 | 1.57 | 0.0921 |
| 3540 | Q93WU3 | 1 | 0.54 | 0.46 | 1.57 | 0.0921 |
| 608 | P02114 | 1 | 0.56 | 0.44 | 1.58 | 0.0922 |
| 2690 | Q5ZI67 | 1 | 0.49 | 0.51 | 1.63 | 0.0923 |
| 221 | O13639 | 1 | 0.51 | 0.49 | 1.58 | 0.0926 |
| 3942 | Q9LT02 | 1 | 0.53 | 0.47 | 1.60 | 0.0927 |
| 3929 | Q9LMU0 | 1 | 0.51 | 0.49 | 1.56 | 0.0928 |
| 3646 | Q9ATM1 | 1 | 0.59 | 0.41 | 1.55 | 0.0929 |
| 1305 | P46202 | 1 | 0.58 | 0.42 | 1.57 | 0.0930 |
| 1221 | P39954 | 1 | 0.50 | 0.50 | 1.60 | 0.0933 |
| 1470 | P54781 | 1 | 0.53 | 0.47 | 1.56 | 0.0934 |
| 2495 | Q59A28 | 1 | 0.50 | 0.50 | 1.56 | 0.0935 |
| 2884 | Q6EE31 | 1 | 0.49 | 0.51 | 1.57 | 0.0935 |
| 1107 | P32564 | 1 | 0.53 | 0.47 | 1.52 | 0.0783 |
| 3315 | Q8HYR6 | 1 | 0.54 | 0.46 | 1.50 | 0.0805 |
| 479 | O80944-3 | 1 | 0.52 | 0.48 | 1.51 | 0.0835 |
| 565 | P00337 | 1 | 0.53 | 0.47 | 1.48 | 0.0844 |
| 478 | O80944-2 | 1 | 0.51 | 0.49 | 1.51 | 0.0869 |
| 272 | O23413 | 1 | 0.62 | 0.38 | 1.53 | 0.0870 |
| 2309 | Q3ZC52 | 1 | 0.55 | 0.45 | 1.51 | 0.0870 |
| 2103 | Q29563 | 1 | 0.54 | 0.46 | 1.46 | 0.0872 |
| 3461 | Q8W245 | 1 | 0.58 | 0.42 | 1.51 | 0.0879 |
| 30 | A2PZE5 | 1 | 0.62 | 0.38 | 1.49 | 0.0881 |
| 2485 | Q58P71 | 1 | 0.56 | 0.44 | 1.47 | 0.0882 |
| 2246 | Q3T0M0 | 1 | 0.54 | 0.46 | 1.48 | 0.0889 |
| 227 | O13950 | 1 | 0.58 | 0.42 | 1.48 | 0.0891 |
| 3920 | Q9LIK7 | 1 | 0.54 | 0.46 | 1.54 | 0.0896 |
| 765 | P0DH60 | 1 | 0.55 | 0.45 | 1.50 | 0.0905 |
| 4309 | Q9XEX2 | 1 | 0.54 | 0.46 | 1.52 | 0.0906 |
| 477 | O80944 | 1 | 0.52 | 0.48 | 1.47 | 0.0910 |
| 1004 | P25847 | 1 | 0.51 | 0.49 | 1.52 | 0.0911 |
| 2695 | Q5ZIL2 | 1 | 0.54 | 0.46 | 1.48 | 0.0911 |
| 532 | O94265 | 1 | 0.52 | 0.48 | 1.53 | 0.0913 |
| 1440 | P53727 | 1 | 0.52 | 0.49 | 1.47 | 0.0913 |
| 3357 | Q8L7M4 | 1 | 0.51 | 0.49 | 1.46 | 0.0915 |
| 4022 | Q9P7C9 | 1 | 0.55 | 0.45 | 1.46 | 0.0918 |
| 1224 | P39988 | 1 | 0.51 | 0.49 | 1.54 | 0.0923 |
| 703 | P07991 | 1 | 0.51 | 0.49 | 1.54 | 0.0925 |
| 1747 | Q01288 | 1 | 0.50 | 0.50 | 1.50 | 0.0927 |

TABLE 11B

| Seq ID No | SolvScore | AggScore | Allergenicity | Toxicity | Antinutricity | Human Homology |
|---|---|---|---|---|---|---|
| 1834 | −19.79 | 0.62 | 0.31 | 0.00 | 0.00 | 0.22 |
| 362 | −18.81 | 0.56 | 0.35 | 0.00 | 0.22 | 0.25 |
| 2714 | −18.88 | 0.56 | 0.33 | 0.00 | 0.20 | 0.55 |
| 2343 | −17.21 | 0.54 | 0.32 | 0.00 | 0.21 | 0.24 |
| 3607 | −19.85 | 0.59 | 0.33 | 0.00 | 0.21 | 0.29 |
| 2207 | −20.27 | 0.55 | 0.35 | 0.00 | 0.22 | 0.00 |
| 1391 | −18.99 | 0.54 | 0.33 | 0.00 | 0.20 | 0.00 |
| 3986 | −18.98 | 0.52 | 0.56 | 0.20 | 1.00 | 0.29 |
| 1184 | −16.47 | 0.79 | 0.28 | 0.22 | 0.21 | 0.30 |
| 1914 | −20.93 | 0.51 | 0.35 | 0.20 | 0.23 | 0.27 |
| 577 | −18.25 | 0.48 | 0.33 | 0.00 | 0.22 | 0.42 |
| 4313 | −17.88 | 0.51 | 0.33 | 0.00 | 0.20 | 0.24 |
| 1117 | −17.54 | 0.59 | 0.35 | 0.00 | 0.21 | 0.28 |
| 2242 | −18.24 | 0.53 | 0.36 | 0.00 | 0.24 | 0.80 |
| 473 | −16.54 | 0.78 | 0.32 | 0.00 | 0.22 | 0.00 |
| 1739 | −18.25 | 0.53 | 0.34 | 0.00 | 0.21 | 0.24 |
| 4314 | −17.75 | 0.50 | 0.32 | 0.00 | 0.21 | 0.24 |
| 2798 | −15.64 | 0.77 | 0.33 | 0.00 | 0.20 | 0.89 |
| 3960 | −18.32 | 0.48 | 0.34 | 0.00 | 0.22 | 0.28 |
| 844 | −19.96 | 0.38 | 0.32 | 0.00 | 0.00 | 0.89 |
| 3297 | −19.91 | 0.49 | 0.33 | 0.21 | 0.22 | 0.21 |
| 361 | −17.63 | 0.82 | 0.31 | 0.00 | 0.00 | 0.00 |
| 4233 | −18.29 | 0.78 | 0.27 | 0.00 | 0.24 | 0.00 |
| 935 | −17.64 | 0.56 | 0.35 | 0.22 | 0.21 | 0.74 |
| 1763 | −16.09 | 0.83 | 0.32 | 0.20 | 0.21 | 0.00 |
| 2251 | −22.36 | 0.50 | 0.31 | 0.00 | 0.20 | 1.00 |
| 4320 | −19.20 | 0.49 | 0.33 | 0.19 | 0.22 | 0.00 |
| 2234 | −19.29 | 0.45 | 0.32 | 0.19 | 0.21 | 0.97 |
| 1843 | −14.34 | 0.85 | 0.32 | 0.22 | 0.24 | 0.96 |
| 3100 | −17.83 | 0.44 | 0.32 | 0.20 | 0.21 | 0.00 |
| 4161 | −11.99 | 1.15 | 0.32 | 0.00 | 0.21 | 0.00 |
| 1362 | −18.79 | 0.52 | 0.33 | 0.22 | 0.19 | 0.00 |
| 1890 | −17.86 | 0.62 | 0.46 | 0.00 | 0.21 | 0.27 |
| 4386 | −18.04 | 0.67 | 0.30 | 0.00 | 0.23 | 0.00 |
| 602 | −17.93 | 0.52 | 0.29 | 0.24 | 0.23 | 0.86 |
| 814 | −18.58 | 0.57 | 0.33 | 0.00 | 0.20 | 0.94 |
| 1046 | −20.92 | 0.40 | 0.34 | 0.00 | 0.20 | 0.40 |
| 3959 | −20.03 | 0.48 | 0.34 | 0.00 | 0.22 | 0.27 |
| 3813 | −18.96 | 0.51 | 0.33 | 0.00 | 0.21 | 0.24 |
| 259 | −19.19 | 0.57 | 0.49 | 0.24 | 0.23 | 0.40 |
| 544 | −16.66 | 0.53 | 0.39 | 0.00 | 0.19 | 0.29 |
| 683 | −18.18 | 0.46 | 0.86 | 0.00 | 0.20 | 0.25 |
| 3872 | −21.84 | 0.52 | 0.31 | 0.22 | 0.24 | 0.65 |
| 2324 | −18.96 | 0.58 | 0.35 | 0.00 | 0.22 | 0.54 |
| 2796 | −19.96 | 0.46 | 0.35 | 0.00 | 0.21 | 0.37 |
| 4155 | −19.10 | 0.57 | 0.49 | 0.24 | 0.23 | 0.40 |

TABLE 11B-continued

| Seq ID No | SolvScore | AggScore | Allerge- nicity | Toxic- ity | Anti- nutricity | Human Homo- logy |
|---|---|---|---|---|---|---|
| 2701 | −22.19 | 0.51 | 0.32 | 0.00 | 0.20 | 0.96 |
| 1453 | −22.41 | 0.48 | 0.34 | 0.24 | 0.00 | 0.31 |
| 224 | −20.40 | 0.40 | 0.31 | 0.00 | 0.00 | 0.33 |
| 4198 | −18.06 | 0.63 | 0.33 | 0.19 | 0.20 | 0.25 |
| 3657 | −17.48 | 0.55 | 0.34 | 0.00 | 0.21 | 0.92 |
| 2183 | −20.81 | 0.47 | 0.32 | 0.00 | 0.21 | 0.33 |
| 3665 | −20.13 | 0.45 | 0.34 | 0.22 | 0.22 | 0.46 |
| 356 | −16.25 | 0.75 | 0.32 | 0.18 | 0.20 | 0.00 |
| 2112 | −20.30 | 0.48 | 0.35 | 0.18 | 0.20 | 0.94 |
| 1072 | −19.81 | 0.43 | 0.33 | 0.00 | 0.20 | 0.31 |
| 1740 | −18.49 | 0.50 | 0.33 | 0.00 | 0.22 | 0.00 |
| 2330 | −17.96 | 0.56 | 0.33 | 0.00 | 0.21 | 0.26 |
| 1678 | −20.35 | 0.47 | 0.32 | 0.00 | 0.19 | 0.00 |
| 3539 | −18.39 | 0.50 | 0.32 | 0.00 | 0.21 | 0.22 |
| 607 | −17.37 | 0.55 | 0.32 | 0.21 | 0.22 | 0.75 |
| 3453 | −19.14 | 0.77 | 0.33 | 0.19 | 0.21 | 0.32 |
| 3540 | −18.17 | 0.51 | 0.34 | 0.00 | 0.21 | 0.21 |
| 608 | −17.34 | 0.56 | 0.34 | 0.00 | 0.23 | 0.75 |
| 2690 | −18.40 | 0.48 | 0.34 | 0.00 | 0.20 | 0.75 |
| 221 | −19.46 | 0.51 | 0.32 | 0.20 | 0.22 | 0.77 |
| 3942 | −18.32 | 0.61 | 0.33 | 0.18 | 0.20 | 0.43 |
| 3929 | −17.75 | 0.43 | 0.31 | 0.00 | 0.22 | 0.34 |
| 3646 | −13.05 | 0.87 | 0.33 | 0.24 | 0.23 | 0.27 |
| 1305 | −24.17 | 0.49 | 0.33 | 0.00 | 1.00 | 0.32 |
| 1221 | −18.95 | 0.51 | 0.36 | 0.00 | 0.21 | 0.70 |
| 1470 | −19.35 | 0.56 | 0.32 | 0.19 | 0.21 | 0.24 |
| 2495 | −20.70 | 0.49 | 0.31 | 0.00 | 0.24 | 0.94 |
| 2884 | −20.22 | 0.47 | 0.32 | 0.20 | 0.22 | 0.93 |
| 1107 | −14.06 | 0.74 | 0.31 | 0.00 | 0.24 | 0.00 |
| 3315 | −18.36 | 0.60 | 0.33 | 0.23 | 0.00 | 0.87 |
| 479 | −18.99 | 0.32 | 0.31 | 0.00 | 0.23 | 0.43 |
| 565 | −17.65 | 0.58 | 0.31 | 0.00 | 0.18 | 0.90 |
| 478 | −19.19 | 0.32 | 0.31 | 0.00 | 0.22 | 0.43 |
| 272 | −13.56 | 1.09 | 0.31 | 0.00 | 0.21 | 0.00 |
| 2309 | −20.15 | 0.47 | 0.32 | 0.00 | 0.23 | 0.96 |
| 2103 | −18.59 | 0.60 | 0.32 | 0.00 | 0.20 | 0.89 |
| 3461 | −12.98 | 0.92 | 0.33 | 0.23 | 0.22 | 0.22 |
| 30 | −10.82 | 1.16 | 0.33 | 0.00 | 0.24 | 0.23 |
| 2485 | −16.66 | 0.85 | 0.34 | 0.00 | 0.20 | 0.00 |
| 2246 | −18.26 | 0.49 | 0.30 | 0.00 | 0.22 | 0.99 |
| 227 | −19.78 | 0.61 | 0.33 | 0.00 | 0.00 | 0.27 |
| 3920 | −19.75 | 0.64 | 0.34 | 0.19 | 0.19 | 0.36 |
| 765 | −20.85 | 0.45 | 0.32 | 0.00 | 0.00 | 0.26 |
| 4309 | −20.40 | 0.56 | 0.51 | 0.20 | 0.24 | 0.41 |
| 477 | −20.15 | 0.30 | 0.31 | 0.00 | 0.24 | 0.42 |
| 1004 | −21.93 | 0.45 | 0.33 | 0.19 | 0.20 | 0.40 |
| 2695 | −18.37 | 0.49 | 0.30 | 0.00 | 0.22 | 0.97 |
| 532 | −16.27 | 0.56 | 0.31 | 0.19 | 0.23 | 0.00 |
| 1440 | −18.42 | 0.47 | 0.31 | 0.00 | 0.21 | 0.35 |
| 3357 | −21.25 | 0.45 | 0.32 | 0.00 | 0.22 | 0.25 |
| 4022 | −21.51 | 0.39 | 0.33 | 0.00 | 0.00 | 0.37 |
| 1224 | −19.88 | 0.40 | 0.32 | 0.00 | 0.00 | 0.35 |
| 703 | −17.28 | 0.56 | 0.31 | 0.00 | 0.21 | 0.52 |
| 1747 | −19.27 | 0.51 | 0.33 | 0.19 | 0.21 | 0.00 |

Figure 13:
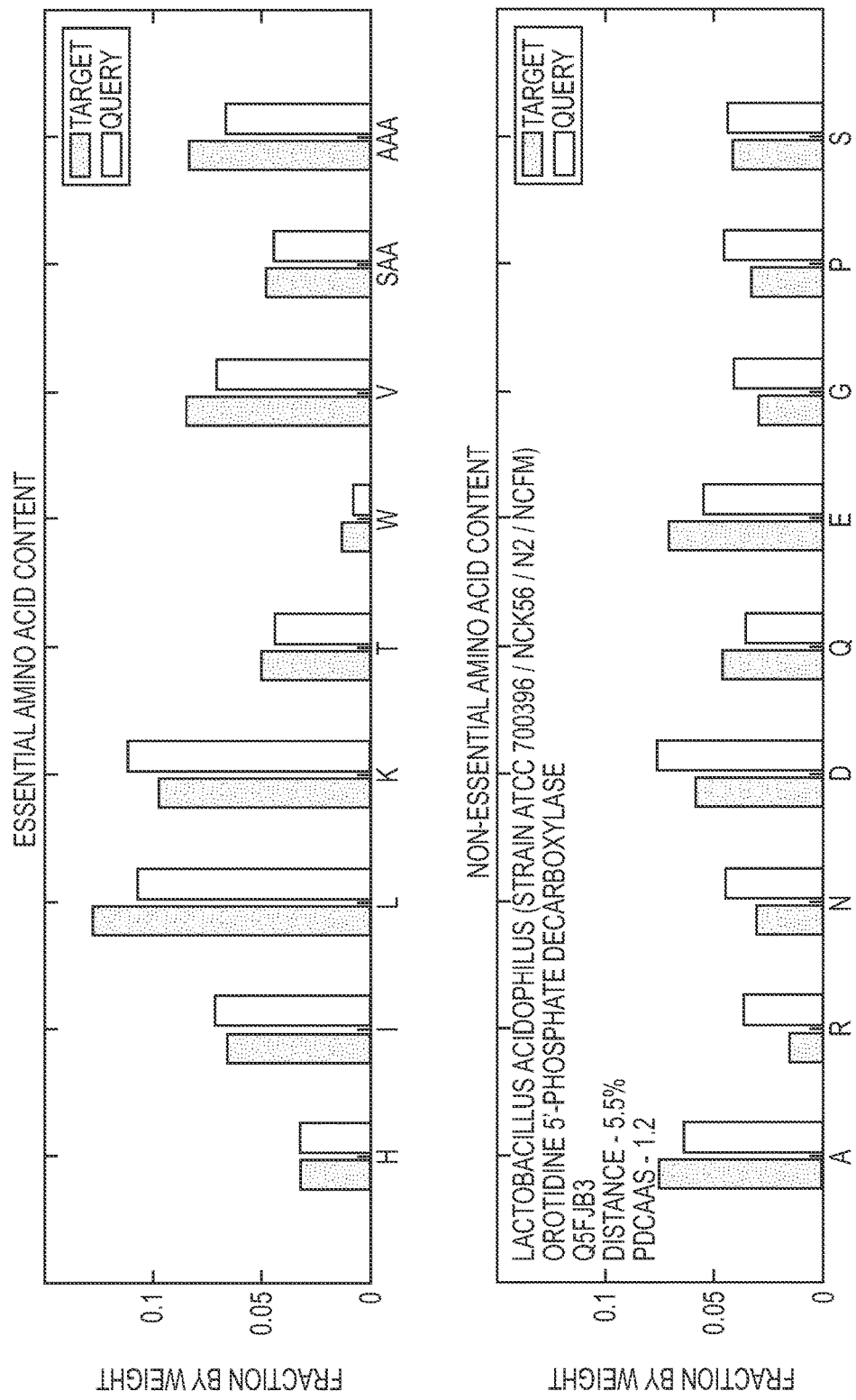
FIG. 13 shows the essential and non-essential amino acid content of the *Lactobacillus acidophilus* orotidine 5'-phosphate decarboxylase protein (UniProt Q5FJB3) (SEQ ID NO: 2530). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the Lactobacillus acidophilus orotidine 5′-phosphate decarboxylase protein (UniProt Q5FJB3) (SEQ ID NO: 2530) is presented in FIG. 13. The protein has a PCDAAS value of 1.22, a Euclidian distance from a 60/40 EAA/NEAA (Whey) target amino acid profile of 0.0547, and a Euclidian distance from a 70/30 EAA/NEAA (Whey) target amino acid profile of 0.0849. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

Figure 14:
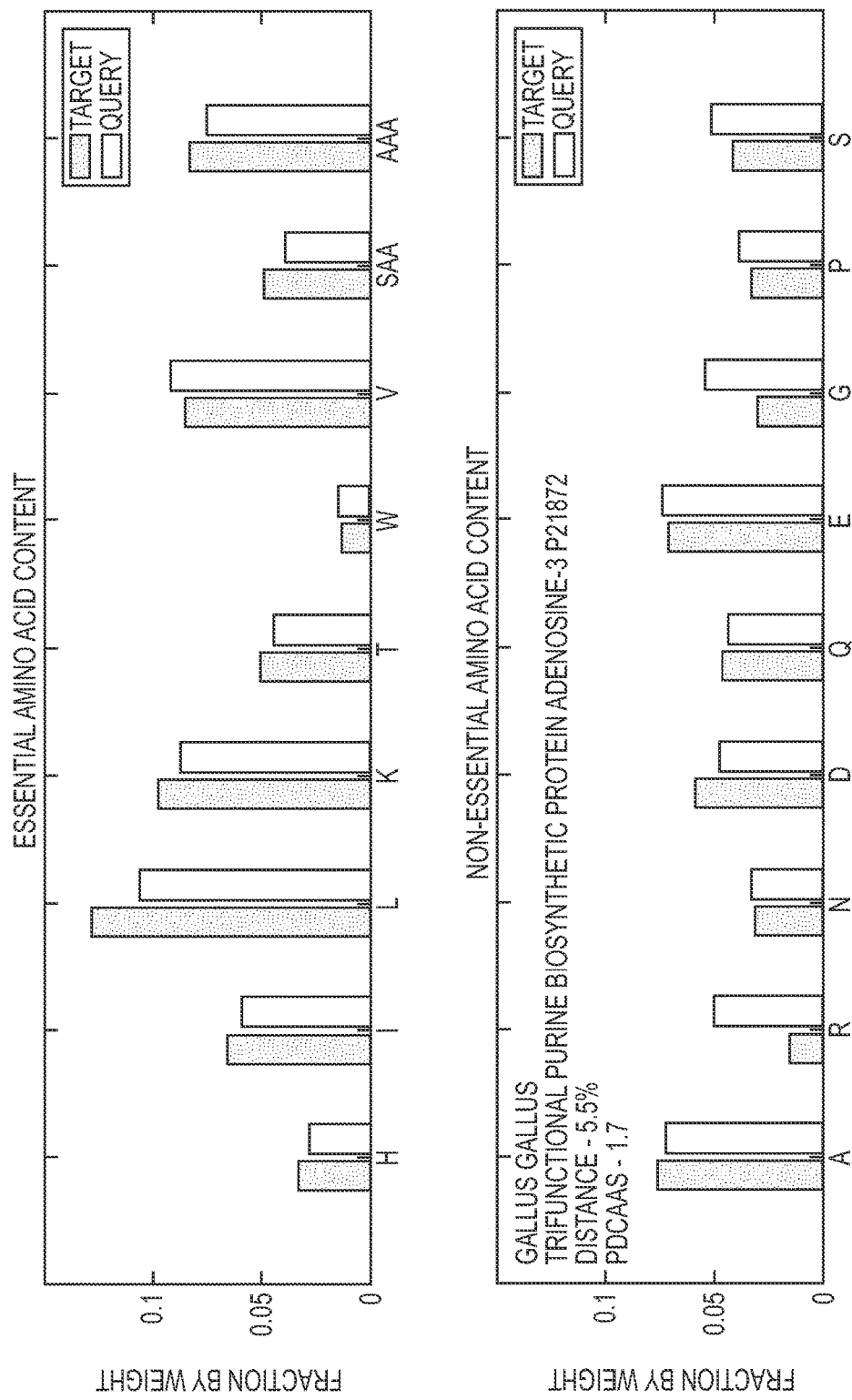
FIG. 14 shows the essential and non-essential amino acid content of the *Gallus gallus* trifunctional purine biosynthetic protein adenosine-3 (UniProt P21872) (SEQ ID NO: 935). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the Gallus gallus trifunctional purine biosynthetic protein adenosine-3 (UniProt P21872) (SEQ ID NO: 935) is presented in FIG. 14. The protein has a PCDAAS value of 1.73, a Euclidian distance from a 60/40 EAA/NEAA (Whey) target amino acid profile of 0.0549, and a Euclidian distance from a 60/40 EAA/NEAA (Whey) target amino acid profile of 0.0898. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

Figure 15:
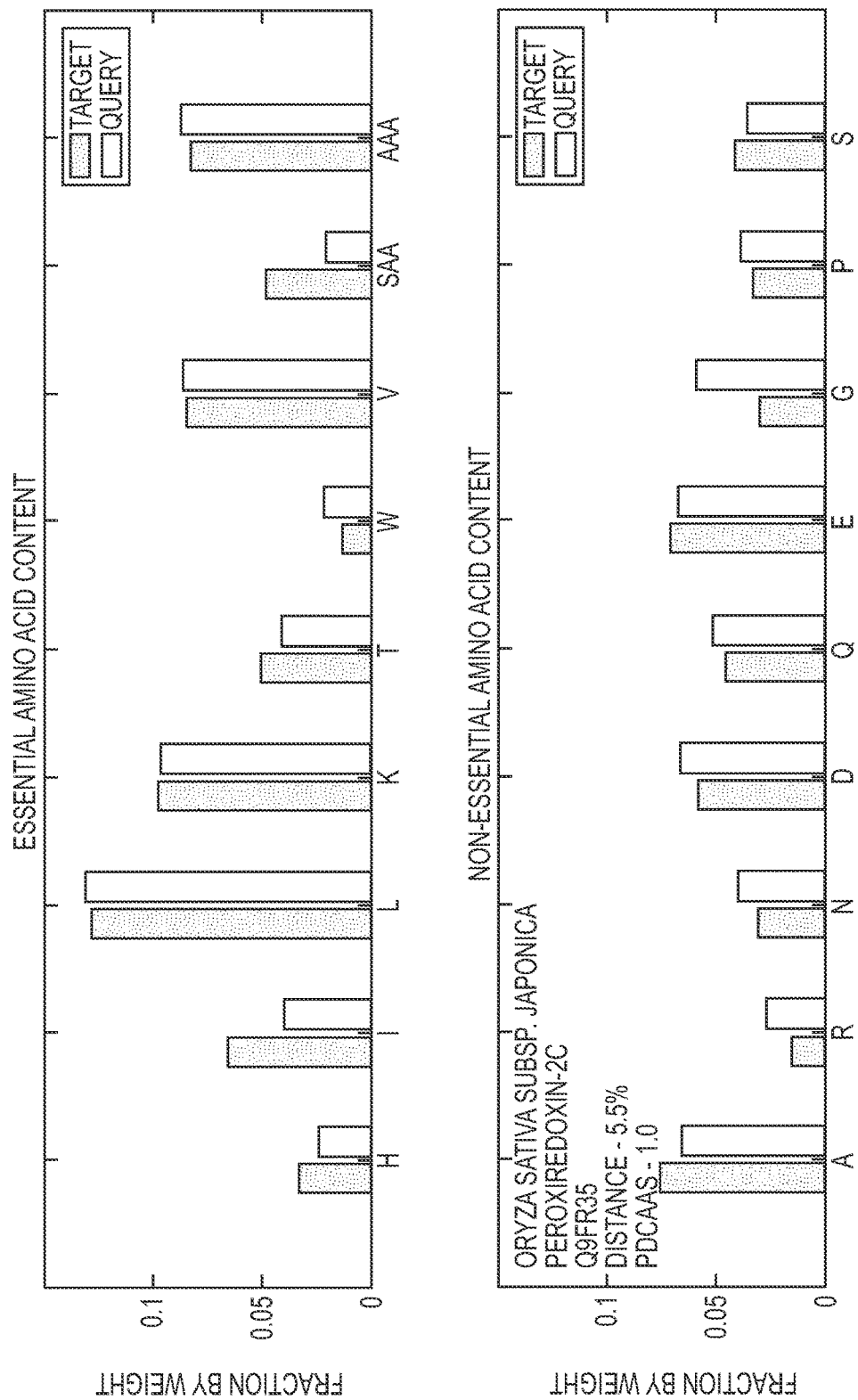
FIG. 15 shows the essential and non-essential amino acid content of the *Oryza sativa* subsp. *japonica* Peroxiredoxin-2C protein (UniProt Q9FR35) (SEQ ID NO: 3830). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the Oryza sativa subsp. japonica Peroxiredoxin-2C protein (UniProt Q9FR35) (SEQ ID NO: 3830) is presented in FIG. 15. The protein has a PCDAAS value of 0.96, a Euclidian distance from a 60/40 EAA/NEAR (Whey) target amino acid profile of 0.0553, and a Euclidian distance from a 60/40 EAA/NEAA (Whey) target amino acid profile of 0.0851. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

Figure 16:
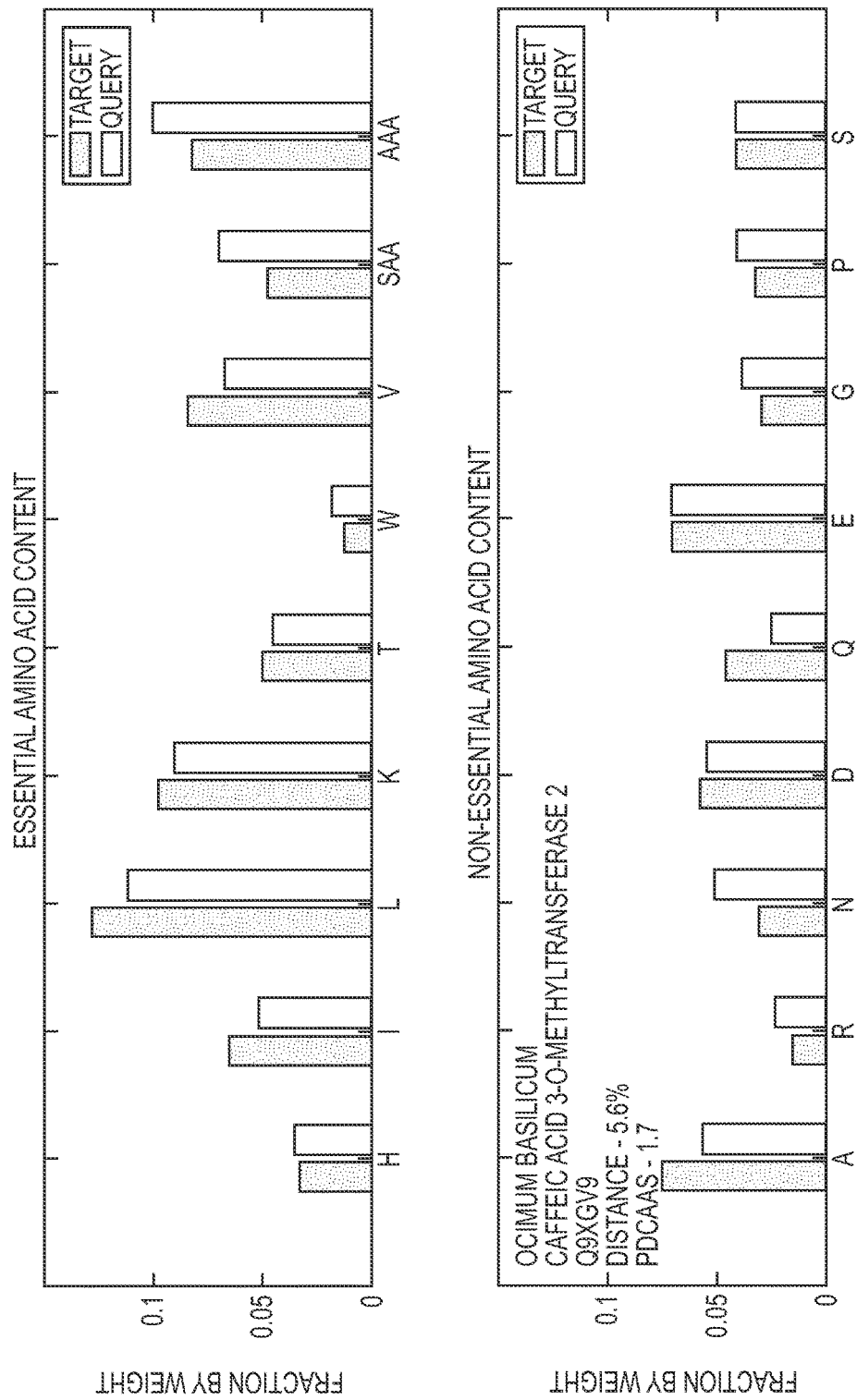
FIG. 16 shows the essential and non-essential amino acid content of the *Ocimum basillicum* caffeic acid 3-O-methyltransferase 2 protein (UniProt Q9XGV9) (SEQ ID NO: 4313). The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

The essential and non-essential amino acid content of the Ocimum basillicum caffeic acid 3-O-methyltransferase 2 protein (UniProt Q9XGV9) (SEQ ID NO: 4313) is presented in FIG. 16. The protein has a PCDAAS value of 1.71, a Euclidian distance from a 60/40 EAA/NEAR (Whey) target amino acid profile of 0.0561, and a Euclidian distance from a 60/40 EAA/NEAR (Whey) target amino acid profile of 0.0787. The top panel presents the fraction by weight of each type/category of essential amino acid in the fragment (white bars) and compares it to the fraction by weight of each type/category of essential amino acid corresponding to the relative required amino acid fraction corresponding to a PCDAAS score of 2.2 (black bars). The bottom panel presents the fraction by weight of each type of non-essential amino acid in the fragment (white bars) and compares it to the fraction by weight of each type of non-essential amino acid present in whey protein (black bars).

Example 6

Analysis of Whey, Casein, Egg, and Soy Proteins and Protein Fragments

For comparison to the proteins and protein fragments identified and analyzed in Examples 2-5, abundant whey, casein, egg, and soy proteins were analyzed for essential amino acid content, non-essential amino acid content, and either PDCAAS value or Euclidian distance from a 60/40 EAA/NEAR (Whey) target amino acid profile.

Table 12 presents whole proteins ranked by PDCAAS value. The proteins are identified by UniProtID number in the first column of the table, their name in the second column, and the source of the protein in the third column.

The fourth column indicates whether the protein contains every essential amino acid (1) or not (0). The fifth and sixth columns present the weight fraction of essential amino acids (EAA), and the total of non-essential and conditionally-essential amino acids (i.e., including C and Y) (NEAA+ CEAA), respectively. The seventh column presents the PDCAAS score for each protein. The proteins are ranked from highest to lowest PDCAAS value.

(EAA), and the total of non-essential and conditionally-essential amino acids (i.e., including C and Y) (NEAA+ CEAA), respectively. The seventh column presents the PDCAAS score for each protein. The eighth column presents the Euclidian distance from a 60/40 EAA/NEAA (Whey) target amino acid profile for each protein. The proteins are ranked from shortest to longest distance from the target profile.

TABLE 12

| SEQID | UniProtID | Name | Source | EAA Complete | [EAA] | [NEAA] | PDCAAS |
|---|---|---|---|---|---|---|---|
| 585 | P01012 | Ovalbumin | Egg | 1 | 0.47 | 0.53 | 1.33 |
| 633 | P02789 | Ovotransferrin | Egg | 1 | 0.45 | 0.55 | 1.31 |
| 574 | P00711 | Alpha-lactalbumin | Whey | 1 | 0.53 | 0.47 | 1.25 |
| 623 | P02666 | Beta-casein | Casein | 1 | 0.48 | 0.52 | 1.24 |
| 625 | P02668 | Kappa-casein | Casein | 1 | 0.44 | 0.56 | 1.17 |
| 655 | P04776 | Glycinin G1 | Soy | 1 | 0.38 | 0.62 | 1.10 |
| 619 | P02662 | Alpha-S1-casein | Casein | 1 | 0.44 | 0.56 | 1.08 |
| 621 | P02663 | Alpha-S2-casein | Casein | 1 | 0.47 | 0.53 | 1.05 |
| 791 | P11828 | Glycinin G3 | Soy | 1 | 0.37 | 0.63 | 1.00 |
| 646 | P04347 | Glycinin | Soy | 1 | 0.36 | 0.64 | 0.93 |
| 627 | P02754 | Beta-lactoglobulin | Whey | 1 | 0.50 | 0.50 | 0.92 |
| 635 | P02858 | Glycinin G4 | Soy | 1 | 0.35 | 0.65 | 0.87 |
| 631 | P02769 | Serum albumin | Whey | 1 | 0.46 | 0.54 | 0.82 |
| 789 | P11827 | Beta-conglycinin alpha prime chain | Soy | 1 | 0.37 | 0.63 | 0.80 |
| 648 | P04405 | Glycinin G2 | Soy | 1 | 0.36 | 0.64 | 0.67 |
| 822 | P13916 | Beta-conglycinin alpha chain | Soy | 1 | 0.34 | 0.66 | 0.59 |
| 1588 | P68390 | Ovomucoid | Egg | 0 | 0.38 | 0.62 | 0.00 |
| 1010 | P25974 | Beta-conglycinin beta chain | Soy | 0 | 0.41 | 0.59 | 0.00 |

Table 13 presents whole proteins ranked by the Euclidian distance from a 60/40 EAA/NEAA (Whey) target amino acid profile. The proteins are identified by UniProtID number in the first column of the table, their name in the second column, and the source of the protein in the third column. The fourth column indicates whether the protein contains every essential amino acid (1) or not (0). The fifth and sixth columns present the weight fraction of essential amino acids The whole protein standards are all significantly less nutritious (as measured by their PDCAAS score) than either the whole protein or fragment candidates identified in Examples 2-5. Ovalbumin has the highest PDCAAS value, at 1.33, while the proteins and fragments presented in Examples 2-5 all have PDCAAS values >1.8. Similarly, while some proteins have EAA/NEAA ratios similar to the WHO 60/40 targets (Beta-lactoglobulin has a distance of ~7%), they still lack high nutritional value (PDCAAS of ~0.9).

TABLE 13

| SEQID | UniProtID | Name | Source | EAA Complete | [EAA] | [NEAA] | PDCAAS | Distance from Target Distribution |
|---|---|---|---|---|---|---|---|---|
| 633 | P02789 | Ovotransferrin | Egg | 1 | 0.45 | 0.55 | 1.31 | 0.0862 |
| 574 | P00711 | Alpha-lactalbumin | Whey | 1 | 0.53 | 0.47 | 1.25 | 0.0945 |
| 585 | P01012 | Ovalbumin | Egg | 1 | 0.47 | 0.53 | 1.33 | 0.0969 |
| 625 | P02668 | Kappa-casein | Casein | 1 | 0.44 | 0.56 | 1.17 | 0.1308 |
| 623 | P02666 | Beta-casein | Casein | 1 | 0.48 | 0.52 | 1.24 | 0.1452 |
| 619 | P02662 | Alpha-S1-casein | Casein | 1 | 0.44 | 0.56 | 1.08 | 0.1133 |
| 621 | P02663 | Alpha-S2-casein | Casein | 1 | 0.47 | 0.53 | 1.05 | 0.1299 |
| 655 | P04776 | Glycinin G1 | Soy | 1 | 0.38 | 0.62 | 1.10 | 0.1412 |
| 791 | P11828 | Glycinin G3 | Soy | 1 | 0.37 | 0.63 | 1.00 | 0.1518 |
| 627 | P02754 | Beta-lactoglobulin | Whey | 1 | 0.50 | 0.50 | 0.92 | 0.0744 |
| 635 | P02858 | Glycinin G4 | Soy | 1 | 0.35 | 0.65 | 0.87 | 0.1452 |
| 646 | P04347 | Glycinin | Soy | 1 | 0.36 | 0.64 | 0.93 | 0.1489 |
| 631 | P02769 | Serum albumin | Whey | 1 | 0.46 | 0.54 | 0.82 | 0.0948 |
| 789 | P11827 | Beta-conglycinin alpha prime chain | Soy | 1 | 0.37 | 0.63 | 0.80 | 0.1572 |
| 648 | P04405 | Glycinin G2 | Soy | 1 | 0.36 | 0.64 | 0.67 | 0.1509 |
| 822 | P13916 | Beta-conglycinin alpha chain | Soy | 1 | 0.34 | 0.66 | 0.59 | 0.1688 |
| 1588 | P68390 | Ovomucoid | Egg | 0 | 0.38 | 0.62 | 0.00 | 0.1388 |
| 1010 | P25974 | Beta-conglycinin beta chain | Soy | 0 | 0.41 | 0.59 | 0.00 | 0.1440 |

Table 14 presents protein fragments ranked by PDCAAS value. The protein fragments are identified by UniProtID number in the first column of the table, the beginning and ending amino acid positions relative to the protein amino acid sequence in the second column, their name in the third column, and the source of the protein in the fourth column. The fifth column indicates whether the protein fragment contains every essential amino acid (1) or not (0). The sixth and seventh columns present the weight fraction of essential amino acids (EAA), and the total of non-essential and conditionally-essential amino acids (i.e., including C and Y) (NEAA+CEAA), respectively. The eighth column presents the PDCAAS score for each protein fragment. The protein fragments are ranked from highest to lowest PDCAAS value.

presents the PDCAAS score for each protein fragment. The ninth column presents the Euclidian distance from a 60/40 EAA/NEAA (Whey) target amino acid profile for each protein fragment. The protein fragments are ranked from shortest to longest distance from the target profile.

The whole protein standards are all significantly less nutritious (as measured by their PDCAAS score) than either the whole protein or fragment candidates identified in Examples 2-5. Ovalbumin has the highest PDCAAS value, at 1.33, while the proteins and fragments presented in Examples 2-5 all have PDCAAS values >1.8. Similarly, while some proteins have EAA/NEAA ratios similar to the WHO 60/40 target (Beta-lactoglobulin has a distance of ~7%), they still lack high nutritional value (PDCAAS of ~0.9).

TABLE 14

| SEQID | UniProtID | Fragment Ends | Name | Source | EAA Complete | [EAA] | [NEAA] | PDCAAS |
|---|---|---|---|---|---|---|---|---|
| 586 | P01012 | 250:332 | Ovalbumin | Egg | 1 | 0.52 | 0.48 | 1.65 |
| 624 | P02666 | 38:159 | Beta-casein | Casein | 1 | 0.49 | 0.51 | 1.62 |
| 575 | P00711 | 5:81 | Alpha-lactalbumin | Whey | 0 | 0.53 | 0.47 | 1.61 |
| 634 | P02789 | 3:171 | Ovotransferrin | Egg | 0 | 0.46 | 0.54 | 1.52 |
| 632 | P02769 | 205:294 | Serum albumin | Whey | 1 | 0.46 | 0.54 | 1.47 |
| 636 | P02858 | 56:103 | Glycinin G4 | Soy | 0 | 0.46 | 0.54 | 1.47 |
| 622 | P02663 | 191:222 | Alpha-S2-casein | Casein | 0 | 0.55 | 0.45 | 1.45 |
| 656 | P04776 | 221:420 | Glycinin G1 | Soy | 1 | 0.40 | 0.60 | 1.38 |
| 792 | P11828 | 228:379 | Glycinin G3 | Soy | 1 | 0.41 | 0.59 | 1.34 |
| 626 | P02668 | 69:133 | Kappa-casein | Casein | 1 | 0.45 | 0.55 | 1.32 |
| 628 | P02754 | 57:177 | Beta-lactoglobulin | Whey | 1 | 0.48 | 0.52 | 1.28 |
| 647 | P04347 | 53:115 | Glycinin | Soy | 1 | 0.47 | 0.53 | 1.23 |
| 620 | P02662 | 87:211 | Alpha-S1-casein | Casein | 1 | 0.39 | 0.61 | 1.21 |
| 649 | P04405 | 127:259 | Glycinin G2 | Soy | 1 | 0.39 | 0.61 | 1.14 |
| 790 | P11827 | 162:341 | Beta-conglycinin alpha prime chain | Soy | 1 | 0.37 | 0.63 | 0.56 |
| 823 | P13916 | 63:216 | Beta-conglycinin alpha chain | Soy | 0 | 0.21 | 0.79 | 0.23 |
| 1589 | P68390 | 1:20 | Ovomucoid | Egg | 0 | 0.39 | 0.61 | 0.00 |
| 1011 | P25974 | 1:20 | Beta-conglycinin beta chain | Soy | 0 | 0.72 | 0.28 | 0.00 |

Table 15 presents protein fragments ranked by the Euclidian distance from a 60/40 EAA/NEAA (Whey) target amino acid profile. The protein fragments are identified by UniProtID number in the first column of the table, the beginning and ending amino acid positions relative to the protein amino acid sequence in the second column, their name in the third column, and the source of the protein in the fourth column. The fifth column indicates whether the protein fragment contains every essential amino acid (1) or not (0). The sixth and seventh columns present the weight fraction of essential amino acids (EAA), and the total of non-essential and conditionally-essential amino acids (i.e., including C and Y) (NEAA+CEAA), respectively. The eighth column Even the best fragments of the whole protein standards are all significantly less nutritious (as measured by their PDCAAS score) than either the whole protein or fragment candidates identified in Examples 2-5. The highest scoring fragment, from ovalbumin, only has a PDCAAS score of 1.6, while the top fragment candidates have scores >2.5. Similar to the full length standard proteins, there are fragments that have EAA/NEAA ratios similar to the WHO 60/40 target (~8%), but they are not nearly as nutritious (PDCAAS of 1.52). Again, for comparison, the top fragment candidates ranked by distance to the WHO 60/40 target show distances <5% with PDCAAS scores ~2.

TABLE 15

| SEQID | UniProtID | Fragment Ends | Name | Source | EAA Complete | [EAA] | [NEAA] | PDCAAS | Distance from Target Distribution |
|---|---|---|---|---|---|---|---|---|---|
| 586 | P01012 | 250:332 | Ovalbumin | Egg | 1 | 0.52 | 0.48 | 1.65 | 0.1293 |
| 575 | P00711 | 5:81 | Alpha-lactalbumin | Whey | 0 | 0.53 | 0.47 | 1.61 | 0.0984 |
| 624 | P02666 | 38:159 | Beta-casein | Casein | 1 | 0.49 | 0.51 | 1.62 | 0.1493 |
| 634 | P02789 | 3:171 | Ovotransferrin | Egg | 0 | 0.46 | 0.54 | 1.52 | 0.0801 |
| 632 | P02769 | 205:294 | Serum albumin | Whey | 1 | 0.46 | 0.54 | 1.47 | 0.1160 |
| 636 | P02858 | 56:103 | Glycinin G4 | Soy | 0 | 0.46 | 0.54 | 1.47 | 0.1317 |
| 622 | P02663 | 191:222 | Alpha-S2-casein | Casein | 0 | 0.55 | 0.45 | 1.45 | 0.2033 |
| 656 | P04776 | 221:420 | Glycinin G1 | Soy | 1 | 0.40 | 0.60 | 1.38 | 0.1253 |
| 628 | P02754 | 57:177 | Beta-lactoglobulin | Whey | 1 | 0.48 | 0.52 | 1.28 | 0.1038 |
| 792 | P11828 | 228:379 | Glycinin G3 | Soy | 1 | 0.41 | 0.59 | 1.34 | 0.1188 |

TABLE 15-continued

| SEQID | UniProtID | Fragment Ends | Name | Source | EAA Complete | [EAA] | [NEAA] | PDCAAS | Distance from Target Distribution |
|---|---|---|---|---|---|---|---|---|---|
| 626 | P02668 | 69:133 | Kappa-casein | Casein | 1 | 0.45 | 0.55 | 1.32 | 0.1737 |
| 647 | P04347 | 53:115 | Glycinin | Soy | 1 | 0.47 | 0.53 | 1.23 | 0.1277 |
| 620 | P02662 | 87:211 | Alpha-S1-casein | Casein | 1 | 0.39 | 0.61 | 1.21 | 0.1395 |
| 649 | P04405 | 127:259 | Glycinin G2 | Soy | 1 | 0.39 | 0.61 | 1.14 | 0.1599 |
| 790 | P11827 | 162:341 | Beta-conglycinin alpha prime chain | Soy | 1 | 0.37 | 0.63 | 0.56 | 0.1612 |
| 823 | P13916 | 63:216 | Beta-conglycinin alpha chain | Soy | 0 | 0.21 | 0.79 | 0.23 | 0.3366 |
| 1589 | P68390 | 1:20 | Ovomucoid | Egg | 0 | 0.39 | 0.61 | 0.00 | 0.2130 |
| 1011 | P25974 | 1:20 | Beta-conglycinin beta chain | Soy | 0 | 0.72 | 0.28 | 0.00 | 0.2717 |

Example 7

Protein Fragmentation Analysis

Figure 17:
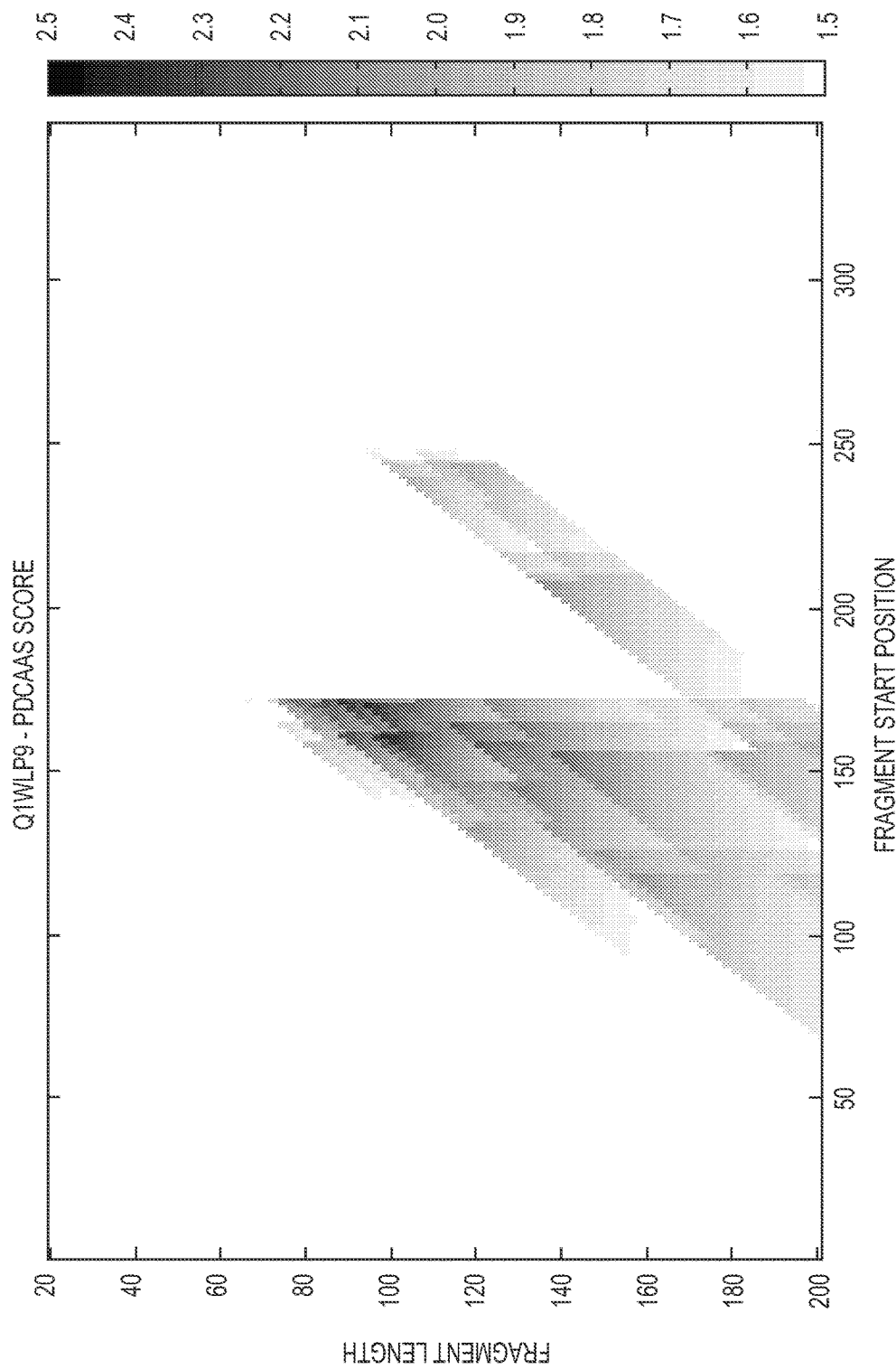
FIG. 17 is a heat map of the PDCAAS scores of fragments of the *Ovis aries* C—C chemokine receptor 9 protein (UniProt Q1WLP9) (SEQ ID NO: 4403). The fragment length is presented along the Y-axis and the fragment start position along the X-axis.
Figure 18:
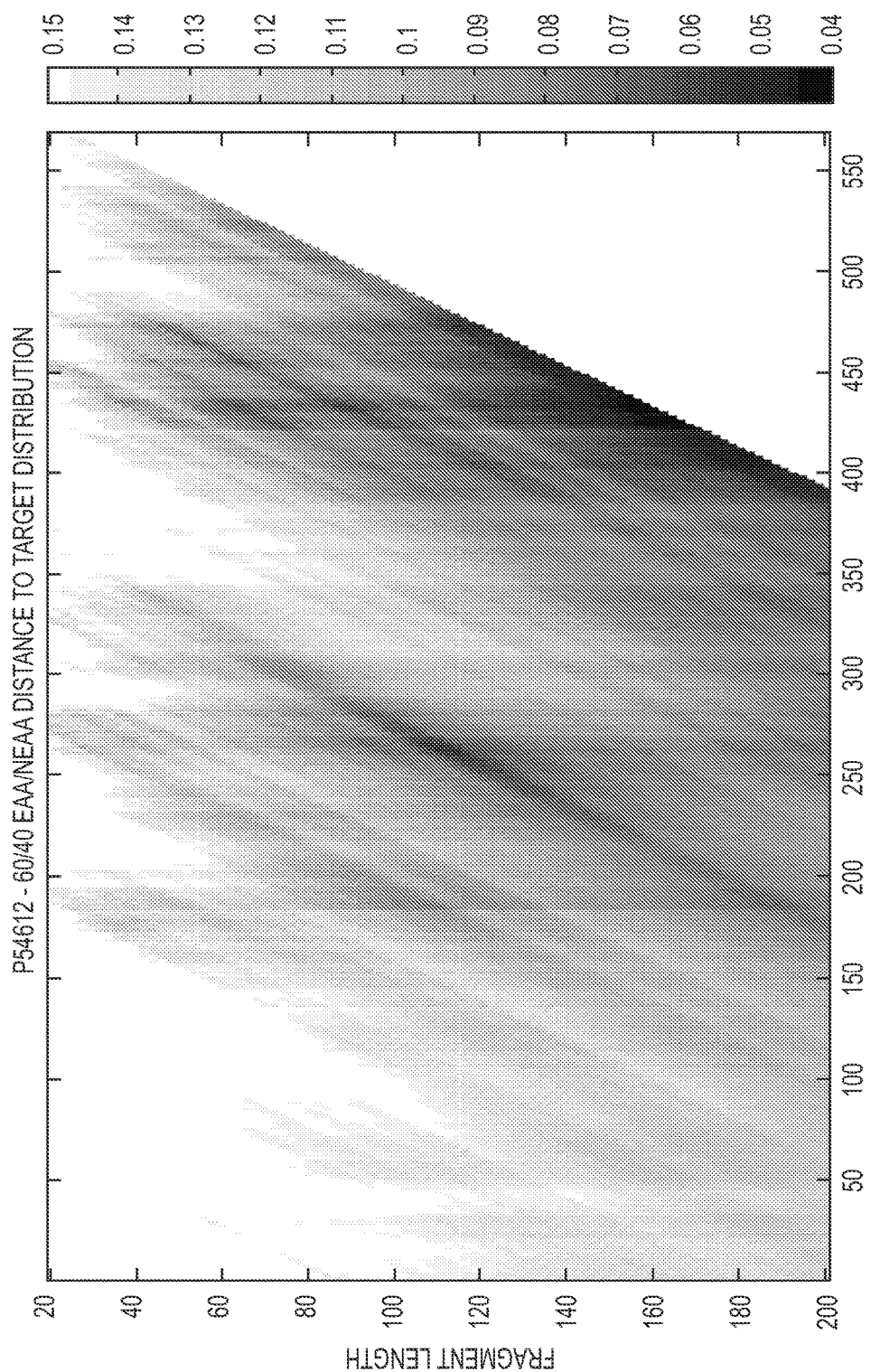
FIG. 18 is a heat map of the 60/40 EAA/NEAA distance to target distribution of fragments of the *Sus scrofa* serine/threonine-protein phosphatase 2A 65 kDa regulatory subunit A alpha isoform protein (UniProt P54612) (SEQ ID NO: 4404). The fragment length is presented along the Y-axis and the fragment start position along the X-axis.

When a protein is broken into overlapping fragments and the EAA and NEAA content of the fragments is analyzed, fragments that overlap with each other will tend to have similar EAA and NEAA content profiles and thus necessarily similar PDCAAS values and similar Euclidian distances from a 60/40 EAA/NEAA (Whey) target amino acid profile and a 60/40 EAA/NEAA (Whey) target amino acid profile. In Tables 7, 8, and 10, only the top fragment identified in each protein is listed for that protein. However, there are likely a multitude of variants that have very similar sequences that are thus very similar in PDCAAS value and distance from an EAA/NEAA (Whey) target profile. One way to visualize this is by performing a full fragmentation analysis and plotting the resulting fragment scores. FIG. 17 plots the PDCAAS values for all fragments of the protein Q1WLP9 (SEQ ID NO: 4403). Clearly, there is a hot spot of overlapping fragments starting around position 150, ending around 170, with lengths between 80 and 120 amino acids. FIG. 18 shows a similar fragmentation analysis for P54612 (SEQ ID NO: 4404) using the distance to the 60/40 EAA/NEAA distribution as the ranking metric.

Example 8

Protein Expression

Genes encoding nutritive proteins of this disclosure were codon optimized for expression in *Escherichia coli* and synthesized by either LifeTechnologies/GeneArt or DNA 2.0. Genes were designed to express the native protein or to contain one of two amino-terminal tags to facilitate purification:

MGSHHHHHHHH (SEQ ID NO: 4431)

MGSSHHHHHHSSGLVPRGSH (SEQ ID NO: 4430)

These gene constructs were inserted into the pET15b plasmid vector (Novagen) using NcoI-BamHI restriction sites (in case of the first tag) or using the NdeI-BamH1 restriction sites (in the case of the second tag). All restriction enzymes were purchased from New England Biolabs. Plasmids were transformed into *Escherichia coli* T7 Express (New England Biolabs) and selected on lysogeny broth (LB) plates containing 100 mg/l carbenicillin. A single colony was picked, grown to $OD_{600nm} \approx 0.6$ in LB with 100 mg/l carbencillin, and stored as a glycerol stock (in LB with 10% glycerol (v/v)) at −80° C., to serve as a master cell stock.

2 ml LB with 100 mg/l carbenicillin (in a 14 mm×100 mm culture tube) was inoculated with a stab from the glycerol stock and grown overnight at 37° C. and 250 rpm. The next day, 2 ml LB with 100 mg/l carbenicillin (in a 14 mm×100 mm culture tube) was inoculated with the overnight culture to $OD_{600nm}=0.05$ and grown at 30° C. or 37° C. and 250 rpm. At $OD_{600nm} \approx 0.8$, heterologous gene-expression was initiated with 1 mM isopropyl β-D-1-thiogalactopyranoside (IPTG) and grown for another 2 hr (when grown at 37° C.) or 4 hr (when grown at 30° C.) until harvest. Upon harvesting, $OD_{600nm}$ was measured, a 1 ml aliquot was centrifuged, and the supernatant was decanted. Cells were re-suspended to $OD_{600nm}=1.50$ for SDS-PAGE analysis to evaluate expression level. 10 µl of resuspended culture was loaded onto either: 1) a Novex® NuPAGE® 12% Bis-Tris gel (Life Technologies), or 2) a Novex®16% Tricine gel (Life Technologies), and run using standard manufacturer's protocols. Gels were stained using SimplyBlue™ SafeStain (Life Technologies) using the standard manufacturer's protocol and imaged using the Molecular Imager® Gel Doc™ XR+ System (Bio-Rad). Over-expressed heterologous protein was identified by comparison against a molecular weight marker and control cultures.

Using this method, recombinant expression of the proteins listed in Tables 16A and 16B was observed.

TABLE 16A

| Seq ID No | UniProt | FragEnds | EAA | BCAA | L | C | PDCAAS |
|---|---|---|---|---|---|---|---|
| 4409 | P02114 | — | 0.56 | 0.24 | 0.12 | 3 | 1.58 |
| 4410 | P67975 | — | 0.50 | 0.25 | 0.13 | 5 | 1.40 |
| 4411 | P12106 | 170:220 | 0.70 | 0.32 | 0.14 | 1 | 1.84 |
| 4412 | P32191 | 112:163 | 0.58 | 0.31 | 0.15 | 1 | 1.27 |
| 4413 | Q03262 | 225:277 | 0.65 | 0.30 | 0.13 | 1 | 1.51 |
| 4414 | P12106 | 159:209 | 0.67 | 0.29 | 0.14 | 1 | 1.77 |
| 4415 | P32492 | 1218:1319 | 0.67 | 0.25 | 0.14 | 1 | 1.47 |
| 4416 | Q2XQV4 | 108:213 | 0.49 | 0.26 | 0.15 | 2 | 1.41 |
| 4417 | P32492 | 1086:1287 | 0.58 | 0.29 | 0.15 | 1 | 1.20 |
| 4418 | Q0WVK7 | 53:105 | 0.57 | 0.27 | 0.12 | 2 | 1.95 |
| 4419 | Q94A52 | 149:261 | 0.54 | 0.26 | 0.12 | 2 | 2.01 |
| 4420 | P38111 | 1093:1165 | 0.59 | 0.30 | 0.13 | 3 | 2.11 |
| 4421 | P38111 | 1093:1182 | 0.57 | 0.27 | 0.13 | 3 | 1.76 |
| 4422 | P38111 | 1093:1162 | 0.57 | 0.27 | 0.13 | 3 | 1.88 |
| 4423 | P38111 | 1092:1166 | 0.59 | 0.29 | 0.13 | 3 | 2.07 |
| 4424 | P38111 | 1093:1168 | 0.58 | 0.29 | 0.13 | 3 | 2.04 |
| 4425 | P38111 | 1091:1164 | 0.59 | 0.30 | 0.13 | 3 | 1.79 |
| 4426 | P38111 | 1089:1164 | 0.58 | 0.29 | 0.13 | 3 | 1.75 |

131

TABLE 16B

| Seq ID No | SolveScore | AggScore | Allergenicity | Toxicity | Anti-nutricity | Human Homology |
|---|---|---|---|---|---|---|
| 4409 | −17.34 | 0.56 | 0.34 | 0.00 | 0.23 | 0.75 |
| 4410 | −21.19 | 0.47 | 0.99 | 0.22 | 0.24 | 0.43 |
| 4411 | −17.13 | 0.77 | 0.20 | 0.31 | 0.28 | 0.61 |
| 4412 | −16.98 | 0.76 | 0.19 | 0.25 | 0.17 | 0.52 |
| 4413 | −19.93 | 0.52 | 0.22 | 0.32 | 0.32 | 0.33 |
| 4414 | −16.05 | 0.65 | 0.20 | 0.28 | 0.31 | 0.65 |
| 4415 | −21.64 | 0.55 | 0.26 | 0.26 | 0.26 | 0.00 |
| 4416 | −17.59 | 0.58 | 0.60 | 0.00 | 0.23 | 0.98 |
| 4417 | −19.98 | 0.57 | 0.31 | 0.00 | 0.24 | 0.00 |
| 4418 | −26.91 | 0.45 | 0.18 | 0.30 | 0.22 | 0.31 |
| 4419 | −25.52 | 0.46 | 0.29 | 0.00 | 0.25 | 0.81 |
| 4420 | −23.00 | 0.80 | 0.27 | 0.00 | 0.24 | 0.26 |
| 4421 | −20.82 | 0.80 | 0.27 | 0.00 | 0.25 | 0.27 |
| 4422 | −23.98 | 0.70 | 0.25 | 0.27 | 0.25 | 0.27 |
| 4423 | −22.45 | 0.79 | 0.27 | 0.27 | 0.25 | 0.25 |
| 4424 | −22.10 | 0.80 | 0.27 | 0.28 | 0.24 | 0.25 |
| 4425 | −22.75 | 0.77 | 0.28 | 0.31 | 0.25 | 0.25 |
| 4426 | −23.28 | 0.71 | 0.28 | 0.28 | 0.25 | 0.24 |

Example 9

Scaled Up Production of Recombinant Nutritive Proteins

A representative protocol for producing quantities of nutritive proteins as described in this disclosure is as follows.

5 ml LB with 100 mg/l carbenicillin (in a 50 ml baffled Pyrex shake flask) is inoculated with a stab from the glycerol stock of a recombinant *E. coli* strain comprising a recombinant gene encoding a nutritive protein and grown until late exponential phase (OD600 nm≈2) at 37° C. and 250 rpm. A 2.5 l Ultra Yield Flask (Thomson Instrument Company) is inoculated with 500 ml sterile water and enough EnBase EnPresso™ tablets (BioSilta) to formulate 500 ml growth medium. This medium is supplemented with 100 mg/l carbenicillin, 0.001% Industrol 204 antifoam, and 0.6 U/l EnzI'm (BioSilta). The shake flask is inoculated to OD600 nm=0.05 and grown 16 hr at 30° C. and 250 rpm. The growth medium is supplemented with EnPresso™ Booster tablets (BioSilta), 1.2 U/l EnzI'm, and 1 mM IPTG to induce heterologous protein production. After another 8-24 hr of shaking at 30° C. and 250 rpm, the flask is harvested by centrifugation, the supernatant is decanted, and the wet cell weight was measured. Approximately 20 gWCW (grams wet cell weight)/l medium is typically recovered at this stage.

The harvested cells from each shake-flask fermentation are suspended in 25 mL of IMAC Equilibration Solution (30 mM Imidazole, 50 mM Phosphate, 0.5 M NaCl, pH 7.5). The suspended cells are then lysed by sonication on ice. The lysed cells are centrifuged for 60 minutes and decanted. The cell debris is discarded, and the supernatants are 0.2 µm filtered. Filters are then flushed with an additional 10 mL of IMAC Equilibration Solution. These filtered protein solutions are then purified by immobilized metal affinity chromatography (IMAC).

IMAC resin (GE Healthcare, IMAC Sepharose 6 Fast Flow) is charged with nickel and equilibrated. 30 mL of each protein solution is loaded onto a 5 mL IMAC column, and washed with additional equilibration solution to remove unbound impurities. The protein of interest is then eluted with 15 mL of 0.5 M NaCl, 0.2 M Imidazole, pH 7.5. At this stage, the purified proteins are typically shown to be at least 90% pure by SDS-PAGE. Approximately 20 to 60 mg of each protein is recovered in the IMAC elution fractions. Each IMAC elution fraction is buffer exchanged by dialysis into a formulation solution (20 mM HEPES, pH 7.5). After buffer exchange, the protein solutions are recovered for all downstream processing.

Example 10

Prediction of Soluble Expression of Nutritive Proteins

Open reading frames encoding a set of 292 nutritive proteins were cloned and introduced into *E. coli* to assess recombinant protein expression using the method of Example 6. In the system used, 163 proteins were identified as expressed while 129 were not. Of the 163 proteins that expressed, 125 were tested for soluble expression. It was found that 75 were solubly expressed while 50 were not.

Figure 19:
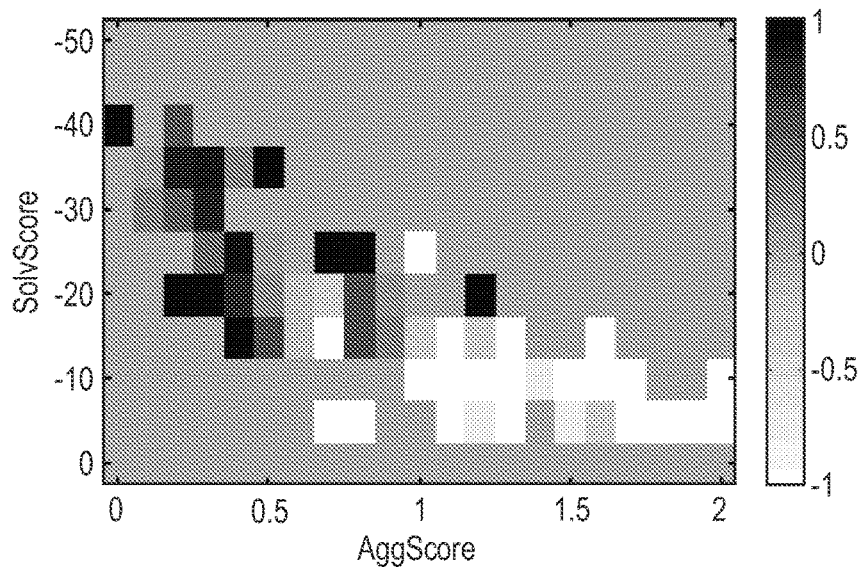
FIG. 19 shows a two dimensional histogram indicating the relative likelihood (on a log scale) of a protein being expressed in an *E. coli* expression screen as a function of solvation score (y-axis) and aggregation score (x-axis).

FIG. 19 shows a two dimensional histogram of protein expression in the *E. coli* expression screen. FIG. 1 shows the relative likelihood (on a log scale) of a protein being expressed as a function of solvation score (y-axis) and aggregation score (x-axis). A darker mark on the histogram indicates a higher number of proteins expressed, while a lighter mark indicates a fewer number of proteins expressed. FIG. 19 shows that those proteins that were successfully expressed tend to cluster in the top left region of the plot, where the solvation score is more negative (≤−20) and the aggregation score is smaller (≤0.75). There were few examples of proteins that were successfully expressed with less negative solvation scores (≥−15) and large aggregation scores (≥1). This result suggests that nutritive proteins with solvation scores of −20 or less and aggregation scores of 0.75 or less are more likely to be expressed in this system.

Figure 20:
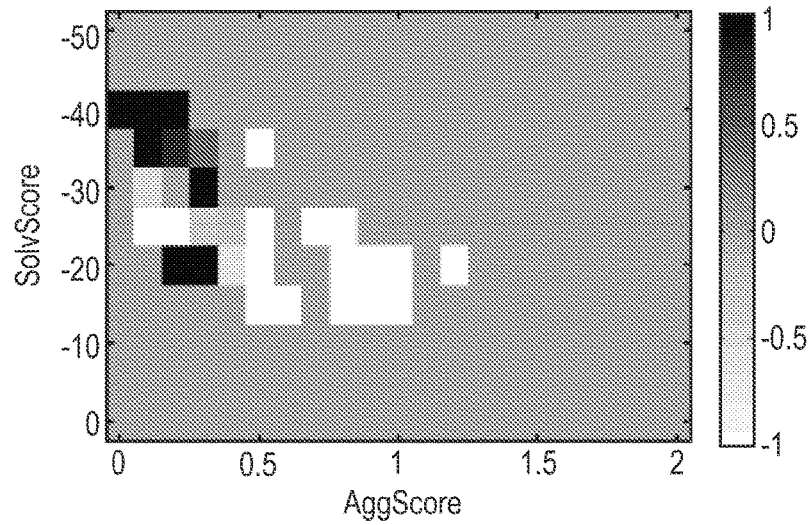
FIG. 20 shows a two dimensional histogram indicating the relative likelihood (on a log scale) of a protein being solubly expressed in an *E. coli* expression screen as a function of solvation score (y-axis) and aggregation score (x-axis).

FIG. 20 shows a two dimensional histogram of the number of soluble protein expression in the *E. coli* expression screen. FIG. 20 shows the relative likelihood (on a log scale) of a protein being solubly expressed as a function of solvation score (y-axis) and aggregation score (x-axis). Again, a darker mark on the histogram indicates a higher number of proteins expressed, while a lighter mark indicates a fewer number of proteins expressed. FIG. 1 shows that those proteins that were expressed solubly tended to cluster in the top left region of the plot, where the solvation score is more negative (≤−20) and the aggregation score is smaller (≤0.5). There were few examples of proteins that were expressed solubly with less negative solvation scores (≥−15) and large aggregation scores (≥0.75). This result suggests that nutritive proteins with solvation scores of −20 or less and aggregation scores of 0.5 or less are more likely to be solubly expressed in this system.

Example 11

Solubility Screening

The solubility of one nutritive protein produced as described Examples 8 and 9 was examined by centrifuge concentration followed by protein concentration assays. Samples in 20 mM HEPES pH 7.5 were tested for protein concentration according to the protocol for Coomassie Plus (Bradford) Protein Assay (Thermo Scientific) and absorbance at 280 nm (if applicable). Based on these measurements 10 mg of protein was added to an Amicon Ultra 3 kDa centrifugal filter (Millipore). Samples were concentrated by centrifugation at 10,000×g for 30 minutes. The final concentrated samples were examined for precipitated protein and color, and then tested for protein concentration as described above. The results are shown in Table 17.

TABLE 17

| Seq ID No | Appearance | Concentration (g/L) |
|---|---|---|
| 4420 | Clear Yellow | 191 |

The solubilities of this nutritive protein was found to be significantly higher than concentrations typically found for whey (12.5 g/L) and soy (10 g/L) (Pelegrine, D. H. G. & Gasparetto, C. A., 2005. Whey proteins solubility as function of temperature and pH. LWT-Food Science and Technology, p. 77-80; Lee, K. H., Ryu, H. S. & and Rhee, K. C., 2003. Protein solubility characteristics of commercial soy protein products. Journal of the American Oil Chemists' Society, pp. 85-90). This demonstrates the usfulness of the nutritive proteins disclosed herein. For example, the solubility of nutritive proteins may improve compliant delivery of high quality protein in as small of a volume as possible while avoiding the "chalkyness" that often characterizes proteins delivered in this manner. This may, for example, be useful to deliver proteins to the elderly or other subjects.

Example 12

Stability Screening

Thermal stability of nutritive proteins provides insight regarding whether the protein is likely to have a useful shelf life. Samples of a protein produced as described in Examples 8 and 9 were screened using a rapid thermal stability screening method. In this method proteins were heated slowly from 25° C. to 95° C. in two representative formulations in the presence of a hydrophobic dye (Enzo Life Sciences, ProteoStat® Thermal shift stability assay kit) that binds to aggregated proteins that form as the protein denatures with increasing temperature (Niesen, F. H., Berglund, H. & Vadadi, M., 2007. The use of differential scanning fluorimetry to detect ligand interactions that promote protein stability. Nature Protocols, Volume 2, pp. 2212-2221). Upon binding, the dye's fluorescence increases significantly, which is then recorded by the rtPCR instrument and represented as the protein's melting curve (Lavinder, J. J., Hari, S. B., Suillivan, B. J. & Magilery, T. J., 2009. High-Throughput Thermal Scanning: A General, Rapid Dye-Binding Thermal Shift Screen for Protein Engineering. *Journal of the American Chemical Society*, pp. 3794-3795). After the thermal shift is complete samples were examined for insoluble precipitates and further analyzed by analytical size exclusion chromatography (SEC).

Protein solutions (12.5 mg/ml) were prepared in both PBS and 20 mM HEPES pH 7.7 buffers, each containing 1×ProteoStat TS Detection Reagent. Samples of each solution were heated slowly from 25° C.-95° C., 0.5° C./30 seconds using a real-time PCR (rtPCR) thermocycler while monitoring the fluorescence of the dye. From this thermal scan the temperature of aggregation was determined ($T_{agg}$) from the temperature with the strongest slope if an increase in fluorescence was observed. To supplement the assay, samples were taken before and after the thermal shift and analyzed by SEC (GE Healthcare—Superdex 75 5/150) which can detect large soluble aggregates. The results for one nutrive proteins of this disclosure and a whey standard are presented in Table 18. The presence of soluble aggregates detected by SEC is noted by a "yes" if observed or "no" if not observed, and the "n/a" entries for the whey standard indicate the production of insoluble precipitates such that no SEC analysis was performed.

TABLE 18

| Seq ID No | HEPES -$T_{agg}$ | PBS - $T_{agg}$ | HEPES - SEC Agg? | PBS - SEC Agg? |
|---|---|---|---|---|
| 4420 | 95 | 95 | Yes | Yes |
| whey | 79 | 81.5 | n/a | n/a |

As shown in Table 18, SEQ ID NO: 4420 had a much higher HEPES $T_{agg}$ than whey (in fact, the protein did not form any insoluble aggregates at 95° C., which was the upper limit of the assay), and thus is expected to be more stable than whey.

Example 13

Digestibility Screening—Determination of Digestion Half-Life

The goal of screening for protein digestibility is to eliminate potentially unsafe allergenic proteins and to determine the relative completeness of digestion as a predictor of peptide bioavailability. This screening method utilizes a physiologically relevant in vitro digestion reaction that includes both phases of protein digestion, simulated gastric digestion and simulated intestinal digestion (Moreno, J. F. et al., 2005. Stability of the major allergen Brazil nut 2S albumin (Ber e 1) to physiologically relevant in vitro gastrointestinal digestion. FEBS Journal, pp. 341-352). Samples can be taken throughout the reaction and analyzed for intact protein and peptide fragments using chip electrophoresis and LC-QTOF-MS. Proteins with allergenic properties can be assessed by identifying proteins or large fragments of proteins that are resistant to digestive proteases and thus have a higher risk of causing an allergenic reaction (Goodman, R. E. et al., 2008. Allergenicity assessment of genetically modified crops—what makes sense?. Nature Biotechnology, pp. 73-81). Digestibility is measured by determining how efficiently the protein is broken down into peptides (Daniel, H., 2003. Molecular and Integrative Physiology of Intestinal Peptide Transport Annual Review of Physiology, Volume 66, pp. 361-384).

The method used an automated assay for in vitro digestions of proteins wherein assay conditions and protease concentrations are physiologically relevant (Moreno, F. J., Mackie, A. R. & Clare Mills, E. N., 2005. Phospholipid interactions protect the milk allergen a-Lactalbumin from proteolysis during in vitro digestion. Journal of agricultural and food chemistry, pp. 9810-9816; Martos, G., Contreras, P., Molina, E. & Lopez-Fandino, R., 2010. Egg White Ovalbumin Digestion Mimicking Physiological Conditions. Journal of Agricultural and food chemistry, pp. 5640-5648; Moreno, J. F. et al., 2005. Stability of the major allergen Brazil nut 2S albumin (Ber e 1) to physiologically relevant in vitro gastrointestinal digestion. FEBS Journal, pp. 341-352). The first phase of digestion is in simulated gastric fluid (SGF) and formulated at pH 1.5 and with a pepsin:substrate ratio of (1:10 w/w). The second phase of digestion is in simulated intestinal fluid (SIF) is formulated with bile salts at pH 6.5 and with an trypsin:chymotrypsin:substrate ratio of (1:4:400 w/w). The protein is treated for 120 mins in the simulated gastric fluid, which is how long it takes for 90% of a liquid meal to pass from the stomach to the small intestine (Kong, F. & Singh, R. P., 2008. Disintegration of Solid Foods in Human Stomach. *Journal of Food Science*, pp. 67-80), and then treated with simulated intestinal fluid for 120 mins. Sample time points are taken throughout both reactions and quenched for analysis. Bovine serum albumin, which is readily digested by pepsin, is the positive control for the SGF solution, and beta-lactoglobulin, which is naturally resistant to pepsin but digested in SIF, is the positive control for SIF solution. Intact protein and large fragments were detected using electrophoresis. For chip electrophoresis, a Caliper Labchip GXII equipped with a HT Low MW Protein Assay Kit was used to monitor the size and amount of intact protein as well as any digestion fragments larger than 4 kDa. By monitoring the amount of intact protein observed over time, the half-life ($\tau_{1/2}$) of digestion was calculated for SGF and, if intact protein is detected after SGF digestion, in SIF.

This method was used to analyze the digestion half-lives of two nutritive proteins of this disclosure (SEQ ID NOS: 4419 and 4420) produced as described in Examples 6 and 7, as well as native and recombinant ovalbumin (OVA and rOVA, respectively; SEQ ID NO: 4427) and beta-lactoglobulin (BLG and rBLG, respectively; SEQ ID NO: 4428) proteins and a whey standard. The results of these experiments are summarized in Table 19. An "n/a" entry in the Simulated Intestinal Fluid field indicates that no intact protein was detected after SGF digestion.

TABLE 19

| Seq ID No. | Digestion $\tau_{1/2}$ (min.) | |
|---|---|---|
| | Simulated Gastric Fluid | Simulated Intestinal Fluid |
| 4419 | 1 | 0 |
| 4420 | 6 | 0 |
| BLG (4428) | 77 | 4 |
| rBLG (4428) | 50 | 0.7 |
| OVA (4427) | 18 | 1 |
| rOVA (4427) | 5 | n/a |
| whey | 99 | 4 |

The results shown in Table 19 indicate that the two nutritive proteins of this disclosure were completely digested by SGF and have SGF half lives of six minutes or less. By comparison whey is not completely digested by SGF and has an SGF half life of 99 minutes and a SIF half life of 4 minutes. This study suggests that the nutritive proteins of this disclosure are likely to be readily digested and not likely to elicit an allergic response when ingested.

The results in Table 19 also show that the recombinant beta-lactoglobulin and ovalbumin produced according to this disclosure were both more readily digested than their naturally-occurring counterparts. The speed in which a protein is broken down can be controlled by selecting for properties that improve or limit accessibility of the gastrointestinal proteases. This capability can be demonstrated for two typical protein properties, glycosylation and disulfide cross-linking Like many naturally occurring proteins, naturally occurring OVA and BLG are glycosylated by their host organisms. In contrast, the recombinant proteins produced according to the present disclosure are not glycosylated because the host organism (*E. coli* in this case) does not glycosylate. The lack of glycolsylation in recombinant nutritive proteins according to this disclosure may result in proteins that are more readily digested. Furthermore, BLG has four disulfide bonds that are known to slow down or interfere with digestion. When these disulfide bonds are disrupted, the rate of digestion increases (Reddy, I. M., Kella, N. K. D. & Kinsella, J. E., 1988. Structural and conformational Basis of the Resistance of b-Lactoglobulin to Peptic and Chymotryptic Digestion. *J. Agric. Food Chem.*, Volume 36, pp. 737-741). A lack or disruption of disulfide bond formation in recombinant nutritive proteins according to this disclosure may result in proteins that are more readily digested.

Example 14

Digestibility Screening—Analysis of Digestion Products

Two nutritive proteins produced as described in Examples 8 and 9 (SEQ ID NOS: 4429 and 4420) were subjected to SGF and SIF digestion as described in Example 11. Both proteins were completely digested in SGF, and the SGF half lives are shown in Table 12.

TABLE 20

| Seq ID No | Digestion $\tau_{1/2}$ (min.) | |
|---|---|---|
| | Simulated Gastric Fluid | Simulated Intestinal Fluid |
| 4429 | 0.7 | n/a |
| 4420 | 6 | n/a |

To detect and identify peptides that were present after SGF and SIF digestion, samples of the SGF and SIF digests were analyzed by LC/Q-TOF MS/MS. Samples from the SGF digests were directly analyzed by LC/Q-TOF MS/MS, while SIF protein digestions required purification by SCX to remove bile acids before detection and identification by LC/Q-TOF MS/MS. Peptides were extracted from the chromatograms and identified using Bioconfirm Software (Aglient). The sequence assignment of peptides were based on accurate mass match (±10 ppm) and further confirmed by MS/MS fragmentation. The results are shown in Tables 21 and 22 below.

TABLE 21

(SEQ ID NO: 4429)

| SGF Peptides 120 min | SEQ ID NO | SIF Peptides 120 min | SEQ ID NO |
|---|---|---|---|
| LL | | SE | |
| LAL | | PSE | |
| HVL | | HVL | |
| LEL | | FKV | |
| LALA | 4432 | HQI | |
| LLLD | 4433 | PSEA | 4434 |
| IAEF | 4435 | REV | |
| IQQF | 4436 | FDK | |
| YDKL | 4437 | AEFK | 4438 |
| SNLTE | 4439 | LKHV | 4440 |
| ELLEA | 4441 | SSSEL | 4442 |

TABLE 21-continued (SEQ ID NO: 4429)

| SGF Peptides 120 min | SEQ ID NO | SIF Peptides 120 min | SEQ ID NO |
|---|---|---|---|
| EELAL | 4443 | FKVF | 4444 |
| DDLLL | 4445 | AELKH | 4446 |
| LAYDK | 4447 | LKHVL | 4448 |
| TKTRL | 4449 | FKEAF | 4450 |
| DLDHQ | 4451 | NGSISSS | 4452 |
| GTLENL | 4453 | SLGLSPS | 4454 |
| EKLTDA | 4455 | GEKLTD | 4456 |
| AEVDDM | 4457 | ELATVM | 4458 |
| LDDLLL | 4459 | GSGEINI | 4460 |
| LDLDHQ | 4461 | RSLGLSP | 4462 |
| DLKKKL | 4463 | ELKHVL | 4464 |
| KTKTRL | 4465 | KLTDAEV | 4466 |
| SQRLEE | 4467 | FKVFDK | 4468 |
| AEVDDML | 4469 | AEVDDML | 4470 |
| QQELDDL | 4471 | DAEVDDM | 4472 |
| LEKTKTR | 4473 | AELKHVL | 4474 |
| LEKTKTR | 4475 | HVLTSIGE | 4476 |
| GTLENLEE | 4477 | SIGEKLTD | 4478 |
| QQELDDLL | 4479 | RSLGLSPSE | 4480 |
| KLEKTKTRLQ | 4481 | VLTSIGEKL | 4482 |
| SRQLKSNDSEQ | 4483 | TSIGEKLTD | 4484 |
| EKTKTRLQQEL | 4485 | HVLTSIGEK | 4486 |
| YDKLEKTKTRL | 4487 | AELKHVLTS | 4488 |
| LAYDKLEKTKTRL | 4489 | RSLGLSPSEA | 4490 |
| EELKKKLLKDLEL | 4491 | SSNLTEEQIA | 4492 |
| EELKKKLLKDLELL | 4493 | RSLGLSPSEAE | 4494 |
| AELKHVLTSIGEKLTD | 4495 | KVFDKNGDGLISA | 4496 |
| MGSHHHHHHHHSSNL | 4497 | FDKDNNGSISSSEL | 4498 |
| LREVSDGSGEINIQQF | 4499 | REVSDGSGEINIQQ | 4500 |
| AAELKHVLTSIGEKLTD | 4501 | DVDGNHQIEFSEF | 4502 |
| AELKHVLTSIGEKLTDAE | 4503 | LREVSDGSGEINIQQ | 4504 |
| AYDKLEKTKTRLQQEL | 4505 | REVSDGSGEINIQQF | 4506 |
| AAELKHVLTSIGEKLTDAE | 4507 | LREVSDGSGEINIQQFAALLS | 4508 |
| LENLEELKKKLLKDLEL | 4509 | | |
| KLEKTKTRLQQELDDLL | 4510 | | |
| DKLEKTKTRLQQELDDLL | 4511 | | |
| LAYDKLEKTKTRLQQELDDDL | 4512 | | |
| LALAYDKLEKTKTRLQQELDDL | 4513 | | |

TABLE 22

(SEQ ID NO: 4420)

| SGF Peptides 120 min | SEQ ID NO | SIF Peptides 120 min | SEQ ID NO |
|---|---|---|---|
| GVL | | TKH | |
| ALL | | INDI | 4514 |
| LVL | | HLVL | 4515 |
| IGVL | 4516 | TIKF | 4517 |
| TIKF | 4518 | IGVLD | 4519 |
| TIKF | 4520 | RNLD | 4521 |
| EVYDL | 4522 | IGVLDV | 4523 |
| LNDSVQ | 4524 | QTIKF | 4525 |
| IWVIND | 4526 | VQTIKF | 4527 |
| DLNDSVQ | 4528 | SVQTIKF | 4529 |
| SVQTIKF | 4530 | KCAKCISMIGVL | 4531 |
| HHLVLGALLD | 4532 | EKCAKCISMIGV | 4533 |
| HHHHHHLVL | 4534 | HEFKRTTYSE | 4535 |
| HHHHHHHLVL | 4536 | SHKFRNLDKDL | 4537 |
| DVTKHEFKRTTY | 4538 | ISMIGVLDVTKHE | 4539 |
| SHHHHHHHHLVL | 4540 | | |
| TKHEFKRTTYSEN | 4541 | | |
| GSHHHHHHHHLVLG | 4542 | | |
| MGSHHHHHHHHLVL | 4543 | | |
| KRTTYSENEVYDLN | 4544 | | |

As can been seen in Tables 21 and 22, each protein was digested into multiple smaller peptide fragments ranging in size from 2 to 22 amino acids (SEQ ID NO: 762) or 2 to 13 amino acids (SEQ ID NO: 763). None of these peptide fragments was found to be homologous to any known allergen.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (4544 sequences)

SEQ ID NO: 1 - protein, 332 aa, Bos grunniens
MATLKDQLIQNLLKEEHVPQNKITIVGVGAVGMACAISILMKDLADEVALVDVMEDKLKGEMMDLQHGSLFLRTPKIVSGKDYNVTANSRLVIITAGARQQEGESRLNLVQRNVNIFKFIIPNIVKYSPNCKLLVVSNPVDILTYVAWKISGFPKNRVIGSGCNLDSARFRYLMGERLGVHPLSCHGWILGEHGDSSVPVWSGVNVAGVSLKNLHPELGTDADKEQWKAVHKQVVDSAYEVIKLKGYTSWAIGLSVVDLAESIMKNLRRVHPISTMIKGLYGIKEDVFLSVPCILGQNGISDVVKVTLTHEEEAYLKKSADTLWGIQKELQF

SEQ ID NO: 2 - protein, 74 aa, Bos grunniens
KLKGYTSWAIGLSVVDLAESIMKNLRRVHPISTMIKGLYGIKEDVFLSVPCILGQNGISDVVKVTLTHEEEAYL

SEQ ID NO: 3 - protein, 77 aa, Bos grunniens
VVDLAESIMKNLRRVHPISTMIKGLYGIKEDVFLSVPCILGQNGISDVVKVTLTHEEEAYLKKSADTLWGIQKELQF

SEQ ID NO: 4 - protein, 128 aa, Mus musculus
VVRTLGHGTYAKVLLAKHWLTGTPVAVKVLLKNKPCFQPAMKEANIMKKIKHPNIVSLLQVFETKTRGYLIMELVEGQELYEYIKSSGHIEEDEARQIFLQILSAVSYCHGLGIVHRDLKPDNIMIDD

SEQ ID NO: 5 - protein, 62 aa, Mus musculus
YAKVLLAKHWLTGTPVAVKVLLKNKPCFQPAMKEANIMKKIKHPNIVSLLQVFETKTRGYLI

SEQ ID NO: 6 - protein, 957 aa, Xenopus tropicalis
MTENPFHYLVEPLSGTSDKTFFNVSKLKATEYDSLPYCIRVVLEAVVRNCDGVLVKEQDAFNILNWKATCEFKEIPFLPARVMLQDFTGIPAMVDFAAMRDAISKFGRDPKQVNPACPTDLIADHSLQLDFTKCIVAQNVSSVPTVETHKPTTKQSPGKTLGRKAQCRSQSGCKGACELGAAHGSSREQIENTPMLCPFHLQPIAEPEAALKSLEIEFNRNKERLQFFKWCTKAFHNVAVIPPETGTVHQVNLEFLSRVVMEEKGFIYPDSVLGTDSHTTMVNGLGILGLGVGGIESEAAMLGVPITLTLPEVIGCELTGAINPLATSIDVVLSITKHLKQAGVAGTFVEFFGNGVSQLSVADRTTIANMCPEYGATVAFFPVDSVTLRHLKQTGVDVQSVSTFETYLQAVKLLRQENVQQPEYSKVLQINLNSIVPYVSGPKRPQDRISVMDMKKDFEACLNEKTGLKGFQIPEKKQSIMVPVTYENSEYSLSHGCVVIAAVTSCTNNCNPSVMLTAGLLAKKAVEAGLTVKPYIKTSLSPGSGTVTYYLSASGVLPYLSKLGFDIIGYGCARCVGNTNPLPESIVTAIKEGELVACGVFSGNKHFEGNRCSCVCANYLASPPLVVAYALAGTVNIDLQTEALGENAQGEKIFLRDIWPSREEVLEVEETMVIPSMFSELKLKIEKQNTRWNLLDAPESTLFPWDLRSTFIRSPPFFHKLEKIPPPIQPIEKAHVLLYLGDSVTTDHMSPAGSIPRTSPAAKYLIQKNLIPREFNSYGARRGNDAVMTRGTFANMKLFNKLVGKTGPKTFHLPSGQIMDVFDAAELYQKAEIPLIIIAGKKYGLGNSRDWAAKGPFLLGVRVVIAESYEKIHKDHLVGMGIAPLQFLSGENAETLGLSAKEQYSFSLPVDLTPRHKIEVKTNTGKTFHVIAAFDNEAEVTFYKHGGILSYVARKYL

SEQ ID NO: 7 - protein, 86 aa, Danio rerio
KCIGADSGQDDLWGKLVCTNFKVSFISHNSLPQQRFQCTHRLLGEHDIPLACVEQVVTVNDVKGKQKILGSNQKLKFNPTELILYC

SEQ ID NO: 8 - protein, 953 aa, Bos taurus
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDSNEAAAADVLEFVREAIQRFDNLRMLIVEKMLEVFHAIKSVKIYRGALWILGEYCSTKDDIQSVMTEVRRSLGEIPIVESEIKKEAGELKPEEEITVGPVQKLVTEMGTYATQSALSSSRPTKKEEERPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNIVDLNDYLQHILKSTNMKCLTPEKALSGYCGFMAANLYARSIFGEDALANVSIEKPIQQGPEAPVTGHIRIRAKSQGMALSLGDKINLSQKKNSI

SEQ ID NO: 9 - protein, 458 aa, Equus caballus
MTILGTTFGMVFYLLQVVSGESGYAQNGDFEDAELDDYSFSCYSQLEVDGPQHLLSCAFEDPDVNSTNLEFEICEGLLEVKCLNFSKLQETYFIKTKKFLLIGDSTICVKLGGKHITCQKLNIVKRVKPEAPFDVKVIYREEANEFVVTFNTSHLQKKYVKDLLHEVVYRLEKNENDWMHVNISSTKLTLLQRKLQPNAMYEIKVRSIPNTNYFEGFWSEWSPSSHFRTPENNSGKMDPVLLIISIVSFFSVALMVILACVLWKKRIKPIVWPSLPDHKKTLEQLCKKPKKNLNVSFNPESFLDCQIHKVDGIQARDEAEAFLQDTFPPQLDDSEKQRLGGGVQGLNWPSQHAVITPKTFGGESPLRCLSGSVTVCDVPVIPSSRPPDCREGGKNGPHVYQGLLLGAGTTNSTLPHLFPFQSGILTLNPAVQGQPLFTSLGSSQEEAYVTMSSFYQNQ

SEQ ID NO: 10 - protein, 192 aa, Equus caballus
KMDPVLLIISIVSFFSVALMVILACVLWKKRIKPIVWPSLPDHKKTLEQLCKKPKKNLNVSFNPESFLDCQIHKVDGIQARDEAEAFLQDTFPPQLDDSEKQRLGGGVQGLNWPSQHAVITPKTFGGESPLRCLSGSVTVCDVPVIPSSRPPDCREGGKNGPHVYQGLLLGAGTTNSTLPHLFPFQSGILTL

SEQ ID NO: 11 - protein, 128 aa, Equus caballus
ICEGLLEVKCLNFSKLQETYFIKTKKFLLIGDSTICVKLGGKHITCQKLNIVKRVKPEAPFDVKVIYREEANEFVVTFNTSHLQKKYVKDLLHEVVYRLEKNENDWMHVNISSTKLTLLQRKLQPNAM

SEQ ID NO: 12 - protein, 54 aa, Bos taurus
FSVCHILLLVHPTCSFDITYDRVFRALDGLRQKVLPLLKTAIKDCPVGKDWKLN

SEQ ID NO: 13 - protein, 49 aa, Bos taurus
VCHILLLVHPTCSFDITYDRVFRALDGLRQKVLPLLKTAIKDCPVGKDW

SEQ ID NO: 14 - protein, 54 aa, Bos taurus; identical to SEQ ID NO: 12

SEQ ID NO: 15 - protein, 49 aa, Bos taurus; identical to SEQ ID NO: 13

SEQ ID NO: 16 - protein, 171 aa, Bos taurus
MAGAELRAALEQRLAALAIRTEVVEHPEVFTVEEMMPHIQHLKGAHSKNLFLKDKKKKGYWLVTVLHDRQINLNDLAKQLGVGSGNLRFADEAAMLEKLKVGQGCATPLALFCDDGDVKFVLDSAFLEGGHEKVYFHPMTNAATMGLSPEDFLTFVKNTGHDPIILNFDKN

SEQ ID NO: 17 - protein, 117 aa, Rattus norvegicus
KNTGKAVLACVGVWIMTLTTTVPLLLLDEDPDKASSPATCLKISDIIHLKAVNVLNFTRLIFFFLIPLFIMIGCYVVIIHSLLRGQTSKLKPKVKEKSIRIIVTLLLQVLACFVPFH

SEQ ID NO: 18 - protein, 93 aa, Rattus norvegicus
FCHILGALVVFYPSLALWLLALISADRYMAIVQPKYAKELKNTGKAVLACVGVWIMTLTTTVPLLLLDEDPDKASSPATCLKISDIIHLKAVN

SEQ ID NO: 19 - protein, 667 aa, Rattus norvegicus
MTQEKKAEDPDRGMDTTSAAPRLWSTHCDGEVLLRLSKHGPGHETPMTIPELFQESVERFGAYPALASKNGKKWDTLTFSQYYDVCRKAARSLIKLGLQRFHGVGILGFNSVEWVVAALGAILAGGLCVGIYATNSAEACQYVIKQANVNVLIVENDQQLQKILSIPPDKMETVKAIVQYRLPLMENSTNLYSWQDFMELGNAIPNIQLDRVILSQKANQCAVIIYTSGTTGSPKGVMLSHDNITWTAGAMAREIELIHVSGKQDTIVSYLPLSHIAAQLMDIWIPIKVGVLTFFAQPDALRGTLVYTLQEVKPTYFLGVPRVWEKMQDTIKENVAKSSNLRKKAFAWAKMLGLKVNTKKMLGKRDIPMNYRMAKALVFTKVRTSLGLDNCHTFFSGASPLSQDVSEFFLSLDIPIGEIYGMTECSGPHTVSCKSIYRVLSCGKVLNGCKNMLYKQNKDGVGEVCMWGRHVFMGYLGKEDATLEVLDEDGWLHSGDIGRLDSHDFLYITGRIKEVLITAGGENIWPIPIETLVKEKIPIISHAMLVGDKAKFLSMLLTLKCETDQMSGEPLDKLNLEAISFCQMLGSQAVTVSDILKIRDPVVYTAIQYGIDIVNQQAVSDSHRIRKWIILEKDFSIQGGELGPTSKLKRDLITQKYKAQIDNMYSS

SEQ ID NO: 20 - protein, 115 aa, Danio rerio
KDVPPSAVTRPICGIMGTIRLVAGVYLIVITKKKKVGDLLGHAVWKASDFDIISYKKTVLHLTDNQMQDNKVFLSMLNSVLNTDGFYFATDYDLTHTLQRLSNTSPEFQEMTLLE

SEQ ID NO: 21 - protein, 66 aa, Danio rerio
MGTIRLVAGVYLIVITKKKKVGDLLGHAVWKASDFDIISYKKTVLHLTDNQMQDNKVFLSMLNSVL

SEQ ID NO: 22 - protein, 192 aa, Mus musculus
MCSVARHMESIMLFTLLGLCVGLAAGTEAAVVKDFDVNKFLGFWYEIALASKMGAYGLAHKEEKMGAMVVELKENLLALTTTYYNEGHCVLEKVAATQVDGSAKYKVTRISGEKEVVVVATDYMTYTVIDITSLVAGAVHRAMKLYSRSLDNNGEALNNFQKIALKHGFSETDIHILKHDLTCVNALQSGQI

SEQ ID NO: 23 - protein, 192 aa, Mus musculus
MCSVARHMESIMLFTLLGLCVGLAAGTEAAVVKDFDVNKFLGFWYEIALASKMGAYGLAHKEEKMGAMVVELKENLLALTTTYYNEGHCVLEKVAATQVDGSAKYKVTRISGEKEVVVVATDYMTYTVIDITSLVAGAVHRAMKLYSRSLDNNGEALNNFQKIALKHGFSETDIHILKHDYIEIKALPKPGS

SEQ ID NO: 24 - protein, 180 aa, Mus musculus
MCSVARHMESIMLFTLLGLCVGLAAGTEAAVVKDFDVNKFLGFWYEIALASKMGAYGLAHKEEKMGAMVVELKENLLALTTTYYNEGHCVLEKVAATQVDGSAKYKVTRISGEKEVVVVATDYMTYTVIDITSLVAGAVHRAMKLYSRSLDNNGEALNNFQKIALKHGFSETDIHILKHD

SEQ ID NO: 25 - protein, 164 aa, Mus musculus
MAVVKDFDVNKFLGFWYEIALASKMGAYGLAHKEEKMGAMVVELKENLLALTTTYYNEGHCVLEKVAATQVDGSAKYKVTRISGEKEVVVVATDYMTYTVIDITSLVAGAVHRAMKLYSRSLDNNGEALNNFQKIALKHGFSETDIHILKHDLTCVNALQSGQI

SEQ ID NO: 26 - protein, 100 aa, Mus musculus
LMDLKDLGVAYIVEVIHHLYSEVKDVLNQTDAVCDKVTEFFILILISVIELHRNKKCLHLLWVSSQQWVEAVVKCAKLPTTAFVRSCEKSPGSTSRGAAI

SEQ ID NO: 27 - protein, 50 aa, Mus musculus
CDKVTEFFILILISVIELHRNKKCLHLLWVSSQQWVEAVVKCAKLPTTAF

SEQ ID NO: 28 - protein, 122 aa, Mus musculus
LTGTHVAVKVIVKRECWFNPVMSEAELLMMTDHPNIISLLQVIETKKKVYLIMELCEGKSLYQHIQNAGYLQEDEARPLFKQLLSAMNYCHNQGIVHRDLTPDNIMVEKDGKVKIIDFGLGT

SEQ ID NO: 29 - protein, 71 aa, Mus musculus
LTGTHVAVKVIVKRECWFNPVMSEAELLMMTDHPNIISLLQVIETKKKVYLIMELCEGKSLYQHIQNAGYL

SEQ ID NO: 30 - protein, 195 aa, Ipomoea nil
VAPTGSVETEKAGPSYKPKEYYKVTEAILRLLLLASLVVAVVVMVTSKETELISVKLDPFPPFMLPLTAKFTQSPAFIYFVAGLSVAGLYTIISTLASFYNLLIKPGFCPALVSHFIILDVVMLGIVGTATGAAGGVAYIGLKGNSHVGWTKVCNKYGKLCTHLGASLAVSFFAFIVLLLLIILSIHSLSKKIPK

SEQ ID NO: 31 - protein, 63 aa, Ipomoea nil
LLIKPGFCPALVSHFIILDVVMLGIVGTATGAAGGVAYIGLKGNSHVGWTKVCNKYGKLCTHL

SEQ ID NO: 32 - protein, 119 aa, Ipomoea nil
KETELISVKLDPFPPFMLPLTAKFTQSPAFIYFVAGLSVAGLYTIISTLASFYNLLIKPGFCPALVSHFIILDVVMLGIVGTATGAAGGVAYIGLKGNSHVGWTKVCNKYGKLCTHLGA

SEQ ID NO: 33 - protein, 76 aa, Solea senegalensis
VLQMKEEDVLKFLAAGTHLGGTNLDFQMDHYVYKRKSDGVYIINLKKTWEKLLLAARAIVAIENPADVCVISSRNT

SEQ ID NO: 34 - protein, 78 aa, Solea senegalensis
VLQMKEEDVLKFLAAGTHLGGTNLDFQMDHYVYKRKSDGVYIINLKKTWEKLLLAARAIVAIENPADVCVISSRNTGQ

SEQ ID NO: 35 - protein, 288 aa, Lactococcus lactis
MIKFEKVNYTYQPNSPFASRALFDIDLEVKKGSYTALIGHTGSGKSTLLQHLNGLLQPTEGKVTVGDIVVSSTSKQKEIKPVRKKVGVVFQFPESQLFEETVLKDVAFGPQNFGIPKEKAEKIAAEKLEMVGLADEFWEKSPFELSGGQMRRVAIAGILAMEPEVLVLDEPTAGLDPKARIEMMQLFESIHQSGQTVVLVTHLMDDVADYADYVYLLEKGHIISCGTPSDVFQEVDFLKAHELGVPKATHFADQLQKTGAVAFEKLPITRAELVTLLTSLSVNSGGEN

SEQ ID NO: 36 - protein, 222 aa, Lactococcus lactis
MRNHDCPTVRFFKARVYKEKETQMTQTKKAKVRNLIIAAMLTALGILIPMMMPVKLIIGPASFTLAAHVPVMAAMFFSPLMTAFVALGTTLGFMISIPVPTIWLRALMHLPVMTVGAYVLKKYPEFVHQKVKIQIFNFILGIFHAGLETLVVYAFYSLGFANIEQGALLNFLLLIALGGLVHSMIDFNLALGLGNVLSKAFPIDIFDKAKNLVNKKKVKAEI

SEQ ID NO: 37 - protein, 140 aa, Lactococcus lactis
KARVYKEKETQMTQTKKAKVRNLIIAAMLTALGILIPMMMPVKLIIGPASFTLAAHVPVMAAMFFSPLMTAFVALGTTLGFMISIPVPTIWLRALMHLPVMTVGAYVLKKYPEFVHQKVKIQIFNFILGIFHAGLETLVV

SEQ ID NO: 38 - protein, 46 aa, Lactococcus lactis
LGTTLGFMISIPVPTIWLRALMHLPVMTVGAYVLKKYPEFVHQKVK

SEQ ID NO: 39 - protein, 380 aa, Lactococcus lactis
MTSIKTKVIHGGISTDKTTGAVSVPIYQTSTYKQNGLGQPKEYEYSRSGNPTRHALEELIADLEGGVQGFAFSSGLAGIHAVLSLFSAGDHIILADDVYGGTFRLMDKVLTKTGIIYDLVDLSNLDDLKAAFKEETKAIYFETPSNPLLKVLDIKEISAIAKAHDALTLVDNTFATPYLQQPIALGADIVLHSATKYLGGHSDVVAGLVTTNSKELASEIGFLQNSIGAVLGPQDSWLVQRGIKTLALRMEAHSANAQKIAEFLETSKAVSKVYYPGLNSHPGHEIAKKQMSAFGGMISFELTDENAVKDFVENLSYFTLAESLGGVESLIEVPAVMTHASIPKELREEIGIKDGLIRLSVGVEAIEDLLTDIKEALEKK

SEQ ID NO: 40 - protein, 926 aa, Rattus norvegicus
MLRAQRLRLARLRACVSRGLHHKPVMALRREDVNAWERRAPLAPKHIKGITKLGYKVLIQPSNRRAIHDKEYVRAGGILQEDITEACLILGVKRPPEEKLMSKKTYAFFSHTIKAQEANMSLLDEVLKQEIRLIDYEKMVDHRGSRIVAFGHWAGVAGMINILHGMGLRLLALGHHTPFMHLGMAHNYRNSSQAVQAVRDAGYEISLGLMPKSIGPLTFVFTGTGNVSKGAQEVFNELPCEYVEPHELKEVSKTGDLRKVYGTVLSRHHHLVRKTDGVYDPVEYEKYPERYISRFNADIAPYTTCLINGIYWEQNTPRLLTRQDAQSLLVPVKSSVVPVEGCPELPHKLVAICDISADTGGSIDFMTECTTIERPFCMYDADQHIIHDSVEGSGILMCSIDNLPAQLPIEATEYFGDMLYPYVEEMLLSDASQPLESQNFSPVVRDAVITSNGLLTDKYKYIQKLRESRERIQFLSMSTKKKVLVLGSGYVSGPVLEYLSRGNNIEITLGSDMTNQMQQLSKKYDINTVNVTVGKQEDKLQSLVESQDLVISLLPYVLHPVVAKACIDSKVNMVTASYITPAMKELEKSVDDAGITVIGELGLDPGLDHMLAMETIDKAKDLGATIESYVSYCGGLPAPEHSDNPLRYKFSWSPVGVLMNIMQPASYLLNGKVVNVTGGVSFLNSVTPMDYFPGLNLEGYPNRDSTKYAEIYGISSAHTLLRGTLRYKGYSKALNGFVKLGLINRETYPALRPEANPLTWKQLLCDLVGISRSSSCEKLKEVVFTKLGGDSTQLEAAEWLGLLGDEQVPQAESIVDAFSKHLVSKLSYGPEEKDMIVMRDSFGIRHPSGHLENKTIDLVVYGDFNGFSAMAKTVGLPTAMAAKMLLDGEIETKGLMGPFSKEIYGPILERIKAEGIVFNTQSTIKL

SEQ ID NO: 41 - protein, 135 aa, Rattus norvegicus
QQLSKKYDINTVNVTVGKQEDKLQSLVESQDLVISLLPYVLHPVVAKACIDSKVNMVTASYITPAMKELEKSVDDAGITVIGELGLDPGLDHMLAMETIDKAKDLGATIESYVSYCGGLPAPEHSDNPLRYKFSW

SEQ ID NO: 42 - protein, 35 aa, Xenopus laevis
RLQVIVCSATLHSFDVKKLSEKIMHFPTWVDLKGE

SEQ ID NO: 43 - protein, 31 aa, Xenopus laevis
LQVIVCSATLHSFDVKKLSEKIMHFPTWVDL

SEQ ID NO: 44 - protein, 507 aa, Xenopus laevis
MAAIGVHLGCTCACVAVFKDGRADVVANDAGDRVTPAVVGFLEKEVIVGLAAKQSRVRNATNTIVKVKQILGRSYGDPIAQKHITESKCTVVEKGGKPKYEIDTGETQKLVSSEDVAKLIFSKMKETAQSALGSDVNDVVITVPFDFGESQKKALGEAASAAGFNILRMIHEPSAALLAYGIGQESPTGKSNVLVYKLGGTSLSVTMIEVNSGIYRVLATSTYDGIGGVCFTEALAQHLASEFQRTYKQDIRGNARAMMKLMNSADVAKHALSTLGSSNCFVDSLYDGIDFDCSVSRARFELICSSLFNQCIDPIKKLLEQVGFKATDVNQVVLCGGSARIPKLQQLIKDLFPEVEMLSSIPPDEVIPVGAAIQAGILLGKENTDLDTITIECSASDMLVKEIDESGNKFTVLLPSGTPLPARRQHVLQAPGNISSVCLELYESDGKSSVSEECKFAQVVLKDLQKKTSGVRDILTVLTMKRDGSLHITCTDKDSGKSEMITIEDTS

SEQ ID NO: 45 - protein, 101 aa, Bos taurus
VLEEIDEHIGELVHRLKVLGLWESLNVIITSDHGMTQCSKDRVINLDGCLDPSYYTLIDLTPVAAILPKINKTKVYSKLKVCDPHMNVYLKEDIPARFHYQ

SEQ ID NO: 46 - protein, 72 aa, Bos taurus
VLGLWESLNVIITSDHGMTQCSKDRVINLDGCLDPSYYTLIDLTPVAAILPKINKTKVYSKLKVCDPHMNVY

SEQ ID NO: 47 - protein, 56 aa, Bos taurus
VADGAAVDGRIHKHSQQPLITYEKYNVTGDPKNIGGSHSLLLLKVHGALMFVAWMT

SEQ ID NO: 48 - protein, 50 aa, Bos taurus
ITYEKYNVTGDPKNIGGSHSLLLLKVHGALMFVAWMTTVSVGVLIARFFK

SEQ ID NO: 49 - protein, 410 aa, Oryza sativa
MTARLALLASLLLLLQLVPPSSAVVLELHGNVYPIGHFFVTMNIGDPAKPYFLDIDTGSTLTWLQCDYPCINCNKVPHGLYKPELKYAVKCTEQRCADLYADLRKPMKCGPKNQCHYGIQYVGGSSIGVLIVDSFSLPASNGTNPTSIAFGCGYNQGKNNHNVPTPVNGILGLGRGKVTLLSQLKSQGVITKHVLGHCISSKGKGFLFFGDAKVPTSGVTWSPMNREHKHYSPRQGTLQFNSNSKPISAAPMEVIFDSGATYTYFALQPYHATLSVVKSTLSKECKFLTEVKEKDRALTVCWKGKDKIRTIDEVKKCFRSLSLKFADGDKKATLEIPPEHYLIISQEGHVCLGILDGSKEHPSLAGTNLIGGITMLDQMVIYDSERSLLGWVNYQCDRIPRSASAITSRL

SEQ ID NO: 50 - protein, 341 aa, Sus scrofa
MDTVRIAVVGAGVMGLSTAVCIFKLVPGCSITVISDKFTPETTSDVAAGMLIPPVYPDTPIHKQKQWFKDTFDHLFAIANSAEAKDAGVLLVSGWQIFQSAPTEEVPFWADVVLGFRKMTKNELKKFPQHVCGQAFTTLKYEGPTYLPWLEKRVKGSGGLVLTRRVEDLWELHPSFDIVVNCSGLGSKQLVGDMDIFPVRGQVLKVQAPWVKHFIRDGSGLTYIYPGLANVTLGGTRQKGDWNLSPNAEISKQILSRCCALEPSLRGACDIREKVGLRPSRPGVRLEKELLVQGSQRLPVVHNYGHGSGGIAMHWGTALEAARLVSECVQALRTPAPKSKL

SEQ ID NO: 51 - protein, 473 aa, Bos taurus
MAKFVLAGRADCPYYAKAELLADYLQKNLPDFRIHKITQHPDIWEEWLKDLCKKNRWSHNKSPIIWRELLDRGGKGLLLGGYNEFLEHAQLYYGVTSSMTTELMKRVAQENLGTHIEKELEKESLKGLVNPLQVWITSASSLACYHLIPILTSGEVFGPQMEISINLFDNKHTEEKLISHKQEAEDLASPCLQSVSICTQAEEAFHGAHVIIILDDHVDKEINSLEDCIRSRAPLCQLYGSLIEKNAHNFAKIIVGGKTFVNLKTALLMKYAPTFAHNIIAVALGVEGQAKAALARKLKITPSCIKDVIIWGNISGNNYVDLRKAKVYRYESAIWGPPHYSRPVLSLLFDREWVNREFVVSLKTLTATGRQFGGMLAAHSIATTLKYWCHGSPPGEIVSLGVLSEGQFGIPKGIVFSMPVKFENGTWVVLTDLKNTEISQQVMTRMANDLIQEQLVALGELANFQPYQSENLI

SEQ ID NO: 52 - protein, 267 aa, Bos taurus
MAEPVRQELSALAAIFCGPDEWEVLSLSETDGAVFRILTKAEGFMDTDIPLQLVFHLPLSYPYCLPGIVVNSKHLTRAQCEIVKEKLLEQAETLLLEPMVHELVLWIQENLRHILKCPEAGGGSEKCSSAASMTVDDGLWMTLLHLDHMRAKAKYVKTVEKWASDLRLTGRLMFMGKIILILLQGDRNDIKEYLILQKTCKVDVDSSGKKCKEKMISVLFETKVQTEHKRFLAFEVKEYSSLDELQKEFETTGLKKLFSECVLRLVK

SEQ ID NO: 53 - protein, 331 aa, Danio rerio
MTLGAVASLILAIGGAAVFSALHKIEEGHVGVYYRGGALLTATSGPGFHLMLPFITTFKSVQTTLQTDEVKNVPCGTGGGVMIYFDRIEVVNYLVPSAVYGIVRNFTADYDKALIFNKVHHELNQFCSVHTLQDVYIGLFDQIDENLKLTLQEDLTSMAPGLIIQAVRVTKPNIPESIRRNYELMESERTKLLIAAQTQKVVEKEAETERKKAVIEAEKVAQVAEIKFGQKVMEKETEKKISQIEDSAYLARQKAKADAEFYSAQRAAEANKLKLTPEYLQLMKFKAIAANSKIYFGSEIPHMFMDSGPGSSSSAASKAIDVLSEGMLDLE

SEQ ID NO: 54 - protein, 118 aa, Bos taurus
EIFLRVEKSLKKFNIDWSKLVSVASTGTPAMVDANDGLVTKLKSKVAMVCKGSDLKSVCCIIHPESLCAQKLKMDHIMSVVVNAVNWICSRGLNHSEFTTLLYELDCQYGSLLYYTEI

SEQ ID NO: 55 - protein, 117 aa, Bos taurus
IFLRVEKSLKKFNIDWSKLVSVASTGTPAMVDANDGLVTKLKSKVAMVCKGSDLKSVCCIIHPESLCAQKLKMDHIMSVVVNAVNWICSRGLNHSEFTTLLYELDCQYGSLLYYTEI

SEQ ID NO: 56 - protein, 539 aa, Xenopus tropicalis
MEDSLFSVDKAGPGKDASAASADCNHMVAEDGIITEQHKEIPLVALKVPDGHAPIDECELLNSDDQLPKGSQNQTNICMRIRAFACPPQGCFSLAITNVTMVILIWAVVWSITGPECLPGGNLFGILALLFSAALGGKLISLIKIPSLPPLPPLLGMLLAGFLIRNIPVITDQVQIHHKWSAALRNIALAIILVRAGLGLDPKALRKLKAVCLRLSFGPCVVESCTAAVVSHFIMGFPLTWGFMLGFVLGAVSPAVVVPSMLILQKEGFGVDKGIPTLLMAAGSFDDVLAITGFNTCLGMAFSSGSTLNTIVRGVLEVVVGIAAGLLFGFFLHYFPSKDQENLKGKRSYLILALSVFAVFGSLYFGFPGSGGLCTLVMAFLAGIGWSTDKTVVEDIIAVSWDIFQPLLFGLIGAEISVASLKPETVGLCTATLIIALIIRICISFLMVCFSGFSLKEKIFISLAWMPKATVQAAIGSVALDTARTLENKQFEDYGMDVLTVAFLGILVTAPIGALVIGLTGPKMLEKSESRTVTEEGSV

SEQ ID NO: 57 - protein, 278 aa, Xenopus tropicalis
MQVHERSHTGGHTCQCNHGSEKKAPATGKVHSEGGSARMSLLILVSIFLCAASIMFLVYKHFPQLSEEEREKIKVPRDMDDAKALGKVLSKYKDTFYVEVLVAYFTTYIFLQTFAIPGSIFLSILSGFLYPFPLALFLVCLCSGLGASFSYLLSYLVGRPVVYKYLSDKAIKWSQQVERHRDHLINYIIFLRITPFLPNWFINITSPVINVPLKVFFLGTFIGVAPPSFVAIKAGTTLYQLTTAGEAVSWNSVIILMVLAVLSILPAIFQKKLKKKFE

SEQ ID NO: 58 - protein, 314 aa, Xenopus tropicalis
MNLIFAKVLCLLAILVLMMLGSLIPVKISEADFDKSSRSRKILSLSNSFAGGVFLATCFNALLPAVREKFFDLLKIGNISTDYPLAETIMMVGFFLTVFVEQTVMTFRKEKPSFIDMETFNAGSDIGSDSEFESPFISANHGHNLYEGGHSHHSHSLNIKELSSSSPIRLFSLVFALSAHSVFEGLALGLQEDGNKLLSLFIGVVIHETLVAMALGVSMAKVNTHLKDAIKMAVLVSTMIPIGIVVGMAIQSAQNMASSIASALLQGIAGGTFIFVTFFEILVKELEEKNDRLLKVLFLVLGYTVLAVLVLFKW

SEQ ID NO: 59 - protein, 364 aa, Pan troglodytes
MPYQYPALTPEQKKELSDIAHRIVAPGKGILAADESTGSIAKRLQSIGTENTEENRRFYRQLLLTADDRVNPCIVGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIAEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 60 - protein, 423 aa, Pan troglodytes
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSREDPYLSIYDPPVPDFTIMKTEVPGSVTGYKVLALDSASILLMVQGTVIASTPTTQTPIPLQRGGVLFIGANESVSLKLTEPKDLLIFRACCLL

SEQ ID NO: 61 - protein, 334 aa, Pan troglodytes
MATLKEKLIAPVAEEEATIPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 62 - protein, 88 aa, Bos taurus
ERLGYVGIEAVLDQLKIKAMKMGFEFNIMVVGQSGLGKSTMVNTLFKSKIWKSTMPGLRVPMPQTLQLHYVTHVIEENGVKLKLTVTD

SEQ ID NO: 63 - protein, 31 aa, Bos taurus
LFKSKIWKSTMPGLRVPMPQTLQLHYVTHVI

SEQ ID NO: 64 - protein, 509 aa, Xenopus laevis
MAAIGVHLGCTCACVAVYKDGRADVVANDAGDRVTPAVVGFLEKEVIVGLAAKQSRVRNAANTIVKVKQILGRSYADPHAQKHISENKCIVVEKGGKPKYEIDTGEIQKLVSSEDVAKLIFSKMKETAQSALGSDVNDVVITVPFDFGESQKKALGEAALAAGFNILRMIHEPSAALLAYGIGQESPTGKSNVLVYKLGGTSLSVTMIEVNSGIYRVLATSTYDGIGGVCFTEALAQHLASEFQRTYKQDIRGNARAMMKLMNSADVAKHALSTLGSANCFVDSLYDGIDFDCSVSRARFELICSSLFNQCIDPIEKLLEQVGCKATDVNQVVLCGGSARIPKLQLLIKDLFPEVEMLSSIPPDEVIPVGAAIQAGILLGKENLSTDLDTITIECLASDILVKETDESGNNKFTVLLPSGTPLPARRQHVLQAPGNISSVCLELYESVGKSTVSEECKFAQIVLKDLQKKASGVHDILTVLTMKRDGSLHITCTDKDSGKSEMITVETS

SEQ ID NO: 65 - protein, 452 aa, Bos taurus
MEFQAVVMAVGGGSRMTDLTSSIPKPLLPVGNKPLIWYPLNLLERVGFEEVIVITTKDVQKALCADFNKMKMKLDIVCIPDEADMGTADSLRHIYQKLKTDVLVLSCDLITDVALHEVVDLFRAHDASLAMLMRKGQESLEPVPGQKGKKKAVEQRDFVGVDSTGKRLLFMANEADLDEELIIKGSILQKHPRIRFHTGLVDAHLYCLKKYVVDFLMENKSITSIRSELIPYLVRKQFSSASSQQGQEEKEEDLKKKELKSLDIYSFIKEANTLTLAPYDTCWNACRGDSWEGLSRSQVRCYVHIMKEGLCSRVSTLGLYMEANRQVSKLLPVICPEESLIHSSAQIVSKHMVGADSLIGPDTQVGEKSSIKHSVIGSSCVIRDRVTVTNCLLMNSVTVEEGSNIQSSIICNDAVIEKGADIKNCLIGSGQRIEAKAKRVNVIVGNDQFLEI

SEQ ID NO: 66 - protein, 166 aa, Bos taurus
VLLDTSIFLGKFLYYFLESLYYKIIPKKKKDVTGEIVLITGAASGLGRLLAIKFASLGAILVLWDINEEGNMETCRIIKEERDAKVFAYTCDCSNRQDVYRVADQVKKEVGNVTILINNAGVVTGREFLKTPDHMVERSFLVNVMSHFWTYKAFLPAMLEANHGHL

SEQ ID NO: 67 - protein, 171 aa, Bos taurus
VLLDTSIFLGKFLYYFLESLYYKIIPKKKKDVTGEIVLITGAASGLGRLLAIKFASLGAILVLWDINEEGNMETCRIIKEERDAKVFAYTCDCSNRQDVYRVADQVKKEVGNVTILINNAGVVTGREFLKTPDHMVERSFLVNVMSHFWTYKAFLPAMLEANHGHLVCISS

SEQ ID NO: 68 - protein, 803 aa, Bos taurus
MIPVTEFRQFSEQQPAFRVLKPWWDVFTDYLSVAMLMIGVFGCTLQVMQDKIICLPKRVQPSQNQSSVSNVSQAVASTTPLPPPKPSPSNPVTVEMKGLKTDLDLQQYSFINQMCYERALHWYAKYFPYLVLIHTLVFMLCSNFWFKFPGSSSKIEHFISILGKCFDSPWTTRALSEVSGEDSEEKDNRKNNMSRSNTTQSGPEGSLVNSQSLKSIPEKFVVDKSTAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWLFYRSLKEYSFEYVRQETGIDDIPDVKNDFAFMLHMIDQYDPLYSKRFAVFLSEVSENKLKQLNLNNEWTPDKLRQKLQTNAHNRLELPLIMLSGLPDTVFEITELQSLKLEIIKNVMIPATIAQLDNLQELSLHQCSVKIHSAALSFLKENLKVLSVKFDDMRELPPWMYGLRNLEELYLVGSLSHDISRNVTLESLRDLKSLKILSIKSNVSKIPQAVVDVSSHLQKMCIHNDGTKLVMLNNLKKMTNLTELELVHCDLERIPHAVFSLLSLQELDLKENNLKSIEEIVSFQHLRKLTVLKLWHNSITYIPEHIKKLTSLERLSFSHNKIEVLPSHLFLCNKIRYLDLSYNDIRFIPPEIGVLQSLQYFSITCNKVESLPDELYFCKKLKTLKIGKNSLSVLSPKIGNLLFLSYLDVKGNHFEILPPELGDCRALKRAGLVVEDALFETLPSDVREQMKTE

SEQ ID NO: 69 - protein, 132 aa, Bos taurus
SQSLKSIPEKFVVDKSTAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWL

SEQ ID NO: 70 - protein, 103 aa, Bos taurus
KALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWL

SEQ ID NO: 71 - protein, 631 aa, Bos taurus
MKGIKKSLTEEYLYLDFSHQKEGCIFPLHTSVTLFLLSYCDCTVFKVFLVLPGESTGISLLKNVPSEGVEIQTISRQELPPIVQSCCLPAVVERPDNFCRAGLAVVLRHIIQKSYEADPSKKEILELLGFKKTCLKACAEVSQWTRLCELTVPLAVENFLKESFDQPPTIPAAILELEKKLSEPVRVHNDDKLRRQKLKQQKAAGVGPSLAKEKTKSKGHRQETSEEGDSSSASLELKVAFSKLTIHKEPASANREPSYVRKAKASDLPPLDHVFAEGLYFTLADIVLLPCIHHFLVIICRKLSGKLVEFPLVAAWYQRIQEVPRVQTAASQCGIQFISLPELQTTSSQQPPNLDEAPSAEEQNDPSFIGGPRPTMTKLMEKGIEVMFSPHPCPTWTLDWDTLPAAVSPKEGKMSSDRALRKQQQLNNLVYMVTNQAKPGDRIVDFCSGGGHVGIVLAHVLPSCQVILIENKELSLIRAKKRSDELGLSNIWFIQANMEYFTGMFNIGVALHACGVATDMVIEHCLKTRASFVTCPCCYGFIQNTSKVNFPKSELFKKTLSYKEHMILCRFADQTAVQLPPQRRLIGKQCMCLVDLDRARAAEEHGFSVQVISMEPESCSPKNNMIVGVPI

SEQ ID NO: 72 - protein, 148 aa, Brucella ovis
LSKVKTPILILSGMAGIEDKVRGLGFGADDYMTKPFHKDELIARIHAIVRRSKGHAQSVITTGDLVVNLDAKTVEVAGQRVHLTGKEYQMLELLSLRKGTTLTKEMFLNHLYGGMDEPELKIIDVFICKLRKKLDAVSGNQSYIETVW

SEQ ID NO: 73 - protein, 123 aa, Brucella ovis
MTKPFHKDELIARIHAIVRRSKGHAQSVITTGDLVVNLDAKTVEVAGQRVHLTGKEYQMLELLSLRKGTTLTKEMFLNHLYGGMDEPELKIIDVFICKLRKKLDAVSGNQSYIETVWGRGYVL

SEQ ID NO: 74 - protein, 93 aa, Mus musculus
SHDIHTMAPLVRSILLVGPSGMGKKMLVQAVCTETGANLFDLSPDNLMGKYPGKNGAQLLVHIVFKVARLLQPSVIWIGNTEKTFYKKVPKEE

SEQ ID NO: 75 - protein, 86 aa, Mus musculus
HDIHTMAPLVRSILLVGPSGMGKKMLVQAVCTETGANLFDLSPDNLMGKYPGKNGAQLLVHIVFKVARLLQPSVIWIGNTEKTFYK

SEQ ID NO: 76 - protein, 64 aa, Rattus norvegicus
CILATKADENHPQFVLVLCNSIGTPLDPKYIDLVPLFVAMTKTHVIAASKEALYTWQYRVAKKL

SEQ ID NO: 77 - protein, 71 aa, Rattus norvegicus
CILATKADENHPQFVLVLCNSIGTPLDPKYIDLVPLFVAMTKTHVIAASKEALYTWQYRVAKKLTALEINQ

SEQ ID NO: 78 - protein, 110 aa, Oncorhynchus mykiss
TTGEVVAFDGSILYLPVKMEEVVHLKSVRRTDNQEVDIKVQMTKILPPNSDLCIPFYNVVLRRVMKILGLKLVGRNHYDPKSAVILGKHRLQVWPGYSTCIKHTDGGLYL

SEQ ID NO: 79 - protein, 193 aa, Oncorhynchus mykiss
ELKDDRTETYVKSIHSQLTSEPNVQLVVCIMTGNRDDLYSAIKKLCCVQSPVPSQAINVRTISQPQKLRSVAQKILLQMNCKLGGELWTVNVPLKHLMVIGVDVHHDTSKKNRSVMGFVASLNSLLTRWYSRVTFQMPNEEIINGFRVCLLAALQKYYGVNHNFPEKIVVYRDGVSDGQLKTVELYEIPQLLK

SEQ ID NO: 80 - protein, 319 aa, Staphylococcus aureus
MKTFGKKVVLIGDGSVGSSYAFAMVTQGVADEFVIIDIAKDKVKADVQDLNHGTVHSPSPVDVKAGEYEDCKDADLVVITAGAPQKPGETRLQLVEKNTKIMKSIVKSVMDSGFDGYFLIAANPVDILTRFVKEYTGLPAERVIGSGTVLDSARLQYLISQELGVAPSSVDASIIGEHGDTELAVWSQANVAGISVYDTLKEQTGSEAKAEEIYVNTRDAAYEIIQAKGSTYYGIALALMRISKAILNNENNVLNVSIQLDGQYGGHKGVYLGVPTLVNQHGAVKIYEMPLSAEEQALFDKSVKTLEDTFDSIKYLLED

SEQ ID NO: 81 - protein, 1133 aa, Bos taurus
MSPTQWDFPVELCCRPMAFVTLTGLDVVYNAVHRAVWDAFCANRRADRVPISFKVLPGDHEYPKCRPKRTSYEWYIPKGILKTGWMNKHLNLVPALVVVFYELDWDEPQWKEKQSECATRVEIVRQSLQGRNTKVAVVLIQKKTPLPPGEDVIASERAAALCNACELSGKSLFVLPHTDHLVGYIIRLENAFYEHAQTYYYTEIRRVKSHKEFLNKTTHQLLFVRHQFKIAFFSELKQDTQNALKNYRTAYNLVHELRAHETNILEIKTMAGFINYKICRLCFQHNTPLDAIAQFRKHIDLCKKKIGSAELAFEHAAWMSKQFQAFGDLFDEAIKLGLTAIQTQNPGFYYQQAAYYAQERKQLAKALCNHEASVTYPNPDPLETQAGVLDFYGQRSWRQGVLSFDLSDPEKEKVGILAIQLKERSVVHSEVIITLLSNAVAQFKKYKCPRMKSHLMVQMGEEYYYAKDYTKALKLLDYVMCDYRSEGWWTLLTSILTTALKCSYLMAQLKDYITYSLELLGRASTLKDDQKSRIEKNLINVLMNESPDPEPDCDILAVKTAQKLWVDRISLAGSNVFTIGVQDFVPFVQCKAKFHAPSFHVDVPVQFDVYLKADCPHPIRFSKLCISFNNQEYNQFCVIEEASKASDVLENLTQGKMCLVPGKTRKFLFKFVAKTEDVGKKIEITSVDLVLGSEAGRCVVLNWQGGGGDAASAQEALQASRSFKRRPRLPDSEVHWDGIVIQASTMIISRVPNISVHLRHDPPALTNEMYCLVVTVQSHEKSPIRDVKLTAGLKPGQDANLTQKTHVTLHGTELCDESYPALLTDIPIGDLQPGEQLEKAVYVRCGTVGSRMFLVYVSYLINTAIEGKETVCKCHKDETVTIETVFPFDVAVKFVSTKFEHLERVYADIPFLLMTDLLSASPWALTIVSSELQLAPSMTPVDQLESQVDRVVLQTGESASECFCLRCPSVGNVEGGVATGHYVISWKRTSATDGVPVISTVITLPHVIVENIPLHVNADLPSFGRVRESLPVRYHLQNKTDLVQDVEISVEPSDAFMFSGLKQIRLRILPGTEQEMLYNFYPLMAGYQQLPSLNINLLRFPNFTNQLLRRFIPTSIFVKPQGRLVDDASIAAA

SEQ ID NO: 82 - protein, 1098 aa, Bos taurus
MLEADLVSKMLRAVLQSHKNGIALPRLQGEYRSLTGDWIPFKQLGYPTLEAYLRSVPAVVRIETSRSGEVTCYAVACTETARIAQLVARQRSSKRKTGRQVNCQMRVKKTMPFFLEGKPKATLRQPGFSSDFSVSKKPNSTLLRNKGISLGVKSDAEVLPYTLQTTIGNEVFKDVPVQSHMTMSTNNRFSPKASLPPRFQMHLSRTCTKEMSDNLNQAVEKPNVTPPASYTYKMDEVQNRIKEILNKHSNGIWISKLPHFYKELYKEELNQGILQQFEHWPHICTVEKPCSGGQDLLLYPAKRKQLLRSELNTEKVPPSPLPAPKQIPPLKGCPAVMPGDFKEKVAELLVKYSSGLWASALPKTFEDMYKVKLPEDALKNLDLLSDVCTVDYISGNPQKAILYAKLPSPADKILKDAEQAHGNYDIKSTVEQEYLQIEENIAESTDTFMETVTIPPLIIPTETSPSVLVVELSNTNEVVIRYVGKDYSAAQELMEDEMKEYYSKNSKVTPVQTVQIGQLLAVNAEEDAWLRAQVISMEEGKIKVCYVDYGFSENVEKSKAYRLNPKFCSLSFQATKCKLAGLEVLSDDPDLVKVVESLTCGKIFAVEILEKTDIPLVVLYDTSGEDDININATCLKAICDKSLEVHLQVDAMYTNVRVTNICSDGTLYCQVPCKGLNKLNDLLHKIEEYFHCKHMTSEYFVSLPFCGKVCLFHCKGKWLRVEITNVHSSRALDVQFLDAGTVTSVKVSELREIPPRFLQEMISVPPQAIKCCLADLPQSIGMWTPDAVLWLRDSVLNCSDCSIKVTKVDETRGIAHIYLFTPKNFPDPHRSINRQITNADLWKHQKDVFLSAISSGASSPNTKSANTPILGNTGETFRKSLTDVLKKSVVNHPSSFFTKELPPPVHLSKPGEHMDVYVPVACHPGYFVIQPWQEIHKLEVLMEEMILYYSVSEERHVAVEKDQVYAAKVENKWHRVLLKGILTNGLVSVYELDYGKHELVNMRKVQPLADMFRKLPFQAVTAQLAGVKCNQWSEEASMVFRNHVEKKPLVALVQTVIENTNPWDRKVVVYLVDTSLPDTDIWIHDFMSEYLVELSKVN

SEQ ID NO: 83 - protein, 129 aa, Bos taurus
LVKVVESLTCGKIFAVEILEKTDIPLVVLYDTSGEDDININATCLKAICDKSLEVHLQVDAMYTNVRVTNICSDGTLYCQVPCKGLNKLNDLLHKIEEYFHCKHMTSEYFVSLPFCGKVCLFHCKGKWL

SEQ ID NO: 84 - protein, 197 aa, Bos taurus
LVKVVESLTCGKIFAVEILEKTDIPLVVLYDTSGEDDININATCLKAICDKSLEVHLQVDAMYTNVRVTNICSDGTLYCQVPCKGLNKLNDLLHKIEEYFHCKHMTSEYFVSLPFCGKVCLFHCKGKWLRVEITNVHSSRALDVQFLDAGTVTSVKVSELREIPPRFLQEMISVPPQAIKCCLADLPQSIGMWTPDA

SEQ ID NO: 85 - protein, 669 aa, Bos taurus
MWTLAGQGWWRGRALAAWVTEAARKGLLWPHLAPARGTAAESRAPDRCYSSADRKEKIDMSCFPVENTRNFSIIAHVDHGKSTLADRLLELTGAIDKTKNNKQVLDKLQVERERGITVKAQTASLFYNYEGKQYLLNLIDTPGHVDFSYEVSRSLSACQGVLLVVDANEGIQAQTVANFFLAFEAQLSIIPVINKIDLKNADPERVEKQIEKVFDIPGDECIKISAKLGTNVESVLDAVIKRIPFPKAHCRNPLRALVFDSTFDQYRGVIANVALFDGVVSKGDKIVSAHTQKTYEVNEVGVLNPNEQPTHKLYAGQVGYLIAGMKDVTEAQIGDTLYLHKQPVEPLPGFKSAKPMVFAGMYPVDQSEYNNLKSAIEKLTLNDSSVVVHRDSSLALGAGWRLGFLGLLHMEVFNQRLEQEYNASVILTTPTVPYKAVLSSAKLIKEYREKEITIINPAQFPDKSKVTEYLEPVVLGTIITPDEYTGKIMMLCQARRAVQKNMMYIDQNRVMLKYLFPLNEIVVDFYDSLKSLSSGYASFDYEDAGYQTAELVKMDILLNGSIVEELVTVVHKDKAYSVGKAICERLKDSLPRQLFEIAIQAALGSKIIARETVKAYRKNVLAKCYGGDITRKMKLLKRQAEGKKKLRKVGNVEVPKDAFIKVLKTQSDK

SEQ ID NO: 86 - protein, 727 aa, Bos taurus
MAFQKAVKGTILVGGGALATVLGLSHFAHYKRKQVNLAFVEAADCISEPVNREPPSREAQILTLKNTSEFDVLVIGGGATGSGCALDAVTRGLKTALVERDDFSSGTSSRSTKLIHGGVRYLQKAIMKLDIEQYRMVKEALHERANLLEIAPHLSAPLPIMLPIYKWWQLPYYWVGIKLYDLVAGSNCLKSSYVLSKSRALEHFPMLQKDKLVGAIVYYDGQHNDARMNLAIALTAARYGAATANYMEVMSLLKKTDPQTGKERVSGARCKDVLTGEEFDVRAKCVINATGPFTDTVRKMDDKDTTAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTKSISRNHVVDISESGLITIAGGKWTTYRSMAEDTINAAVKAHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDSKKEEELETARKFLYYEMGYKSRSEQLTDRSEISLLPSDIDRYKKRFHKFDADQKGFITIVDVQRVLESIGVQMDENTLHEILNEVDLNKNGQVELNEFLQLMSAIQKGRVSGSRLAILMKTAEENLDRRVPIPVDRSCGGL

SEQ ID NO: 87 - protein, 73 aa, Bos taurus
SCKNHKKAKAIRLIFLVVVVFFLFWTPYNVMIFLQTLNLYDFFPKCDVKRDLKLAISVTETIAFSHCCLNPLI

SEQ ID NO: 88 - protein, 65 aa, Bos taurus
HKKAKAIRLIFLVVVVFFLFWTPYNVMIFLQTLNLYDFFPKCDVKRDLKLAISVTETIAFSHCCL

SEQ ID NO: 89 - protein, 168 aa, Bos taurus
EHSPSGEGIGVFQQSSKHSLFDSCKMSRGGPFPEDKVEDVKALVKIVPVFLALIPYWTVYFQMQTTYVLQSLHLKIPEISSITTNPHTFPAAWLTMFDAVLILLLIPLKDKLVDPILKRNGLLPSSLKRIAVGMFFVMCSAFAAGILESKRLDLVKEKTINQTIGNVV

SEQ ID NO: 90 - protein, 97 aa, Bos taurus
KHSLFDSCKMSRGGPFPEDKVEDVKALVKIVPVFLALIPYWTVYFQMQTTYVLQSLHLKIPEISSITTNPHTFPAAWLTMFDAVLILLLIPLKDKLV

SEQ ID NO: 91 - protein, 454 aa, Medicago truncatula
MSTFKNEMNGNNLLHVAVLAFPFGTHAAPLLSLVKKIATEAPKVTFSFFCTTTTNDTLFSRSNEFLPNIKYYNVHDGLPKGYVSSGNPREPIFLFIKAMQENFKHVIDEAVAETGKNITCLVTDAFFWFGADLAEEMHAKWVPLWTAGPHSLLTHVYTDLIREKTGSKEVHDVKSIDVLPGFPELKASDLPEGVIKDIDVPFATMLHKMGLELPRANAVAINSFATIHPLIENELNSKFKLLLNVGPFNLTTPQRKVSDEHGCLEWLDQHENSSVVYISFGSVVTPPPHELTALAESLEECGFPFIWSFRGDPKEKLPKGFLERTKTKGKIVAWAPQVEILKHSSVGVFLTHSGWNSVLECIVGGVPMISRPFFGDQGLNTILTESVLEIGVGVDNGVLTKESIKKALELTMSSEKGGIMRQKIVKLKESAFKAVEQNGTSAMDFTTLIQIVTS

SEQ ID NO: 92 - protein, 502 aa, Hyoscyamus muticus
MQFFSLVSIFLFLSFLFLLRKWKNSNSQSKKLPPGPWKLPLLGSMLHMVGGLPHHVLRDLAKKYGPLMHLQLGEVSAVVVTSPDMAKEVLKTHDIAFASRPKLLAPEIVCYNRSDIAFCPYGDYWRQMRKICVLEVLSAKNVRSFSSIRRDEVLRLVNFVRSSTSEPVNFTERLFLFTSSMTCRSAFGKVFKEQETFIQLIKEVIGLAGGFDVADIFPSLKFLHVLTGMEGKIMKAHHKVDAIVEDVINEHKKNLAMGKTNGALGGEDLIDVLLRLMNDGGLQFPITNDNIKAIIFDMFAAGTETSSSTLVWAMVQMMRNPTILAKAQAEVREAFKGKETFDENDVEELKYLKLVIKETLRLHPPVPLLVPRECREETEINGYTIPVKTKVMVNVWALGRDPKYWDDADNFKPERFEQCSVDFIGNNFEYLPFGGGRRICPGISFGLANVYLPLAQLLYHFDWKLPTGMEPKDLDLTELVGVTAARKSDLMLVATPYQPSRE

SEQ ID NO: 93 - protein, 60 aa, Bos taurus
DYSQMDELALLSLRTSIIEAQFLWYHDIKPGALVKGKVLTIKPHGMVVKMGKQIRGLVPT

SEQ ID NO: 94 - protein, 133 aa, Bos taurus
LSLRTSIIEAQFLWYHDIKPGALVKGKVLTIKPHGMVVKMGKQIRGLVPTMHLADILIKNPEKKYHVGDEVKCRVLLCDPKAKKLMMTLKKTLVESKLPAITCYDDAKPGLQTHGFILRVKDYGCIVKFYNDV

SEQ ID NO: 95 - protein, 394 aa, Bos taurus
MDSQGRKVVVCDNGTGFVKCGYAGSNFPEHIFPALVGRPIIRSTTKVGNIEIKDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 96 - protein, 617 aa, Bos taurus
MDLKTAVFNAARDGKLRLLTKLLASKSKEEVSSLISEKTNGATPLLMAARYGHLDMVEFLLEQCSASIEVGGSVNFDGETIEGAPPLWAASAAGHLKVVQSLLNHGASVNNTTLTNSTPLRAACFDGHLEIVKYLVEHKADLEVSNRHGHTCLMISCYKGHKEIAQYLLEKGADVNRKSVKGNTALHDCAESGSLDIMKMLLMYCAKMEKDGYGMTPLLSASVTGHTNIVDFLTHHAQTSKTERINALELLGATFVDKKRDLLGALKYWKKAMNMRYSDRTNIISKPVPQTLIMAYDYAKEVNSAEELEGLIADPDEMRMQALLIRERILGPSHPDTSYYIRYRGAVYADSGNFKRCINLWKYALDMQQNNLDPLSPMTASSLLSFAELFSFMLQDRAKGLLGTTVTFDDLMGILCKSVLEIERAIKQTQCPADPLQLNKALSIILHLICLLEKVPCTLEQDHFKKQTIYRFLKLHPRGKNNFSPLHLAVDKNTTCVGRYPVCKFPSLQVTAILIECGADVNVRDSDDNSPLHIAALNNHPDIMNLLIKSGAHFDATNLHKQTASDLLDEKEIAKNLIQPINHTTLQCLAARVIVNHRIYYKGHIPEKLETFVSLHR

SEQ ID NO: 97 - protein, 202 aa, Vitis vinifera
MESQCRPNVDGVHNGVESHVKVVEKPRSVGSSSEFVLRILGLLLTLIAAVVAGVDKQTKIIPLTLIKTLPSLHVPVTAKWSDMSAFVYLVVSNAIACSYAAISLVLVTMLGRRGKGGRVLAVIVLDLHMVGLLFSANGAATAVGVLGQYGNSHVEWKKVCNVFDSFCHHLVASLALSFLGSLSFLGLVLLAILNLHKKSSTK

SEQ ID NO: 98 - protein, 204 aa, Vitis vinifera
MASKGEEKPELVGSKQGIVSVTKAKHDQIVLVLRVVAFLATASATIVMGLNQETKTLLVGTIGTTPIRATLKAKFQHTPAFVFFVVANGLASVYNLVMLGVDVFGRKLDCKGLRLVIISILDMVIVAVVAAGASSAAFMAELGKNGNSHAKWNKICDKFESFCHQGGGALIPSFIALLLLFLISAISIITLHNQKLTSPHATTP

SEQ ID NO: 99 - protein, 132 aa, Vitis vinifera
KAKHDQIVLVLRVVAFLATASATIVMGLNQETKTLLVGTIGTTPIRATLKAKFQHTPAFVFFVVANGLASVYNLVMLGVDVFGRKLDCKGLRLVIISILDMVIVAVVAAGASSAAFMAELGKNGNSHAKWNK

SEQ ID NO: 100 - protein, 159 aa, Vitis vinifera
EEKPELVGSKQGIVSVTKAKHDQIVLVLRVVAFLATASATIVMGLNQETKTLLVGTIGTTPIRATLKAKFQHTPAFVFFVVANGLASVYNLVMLGVDVFGRKLDCKGLRLVIISILDMVIVAVVAAGASSAAFMAELGKNGNSHAKWNKICDKFESFCH

SEQ ID NO: 101 - protein, 342 aa, Mus musculus
MSRVLVVGAGLTGSLCAALLRKEITAPLYLGLWDKGGDIGGRMITASSPHNPRCTADLGAQYITCSPHYVKEHQNFYEELLAHGILKPLTSPIEGMKGKEGDCNFVAPQGFSSVIKYYLKKSGAEVSLKHCVTQIHLKDNKWEVSTDTGSAEQFDLVILTMPAPQILELQGDIVNLISERQREQLKSVSYSSRYALGLFYEVGMKIGVPWSCRYLSSHPCICFISIDNKKRNIESSECGPSVVIQTTVPFGVQHLEASEADVQKLMIQQLETILPGLPQPVATICHKWTYSQVTSSVSDRPGQMTLHLKPFLVCGGDGFTHSNFNGCISSALSVMKVLKRYI

SEQ ID NO: 102 - protein, 42 aa, Mus musculus
LLYGTFSKGKCHWLKSTMIFMFSVIAVTGVMLILHLKQRVPV

SEQ ID NO: 103 - protein, 54 aa, Mus musculus
GTFSKGKCHWLKSTMIFMFSVIAVTGVMLILHLKQRVPVSDQHFELDTLWLEDI

SEQ ID NO: 104 - protein, 42 aa, Mus musculus; identical to SEQ ID NO: 102

SEQ ID NO: 105 - protein, 54 aa, Mus musculus; identical to SEQ ID NO: 103

SEQ ID NO: 106 - protein, 42 aa, Mus musculus; identical to SEQ ID NO: 102

SEQ ID NO: 107 - protein, 54 aa, Mus musculus; identical to SEQ ID NO: 103

SEQ ID NO: 108 - protein, 62 aa, Mus musculus
VQKESCNKRNPFWKKYALDLGISVFTIIVVTLIMHLKQREADQHFELNTLWSKDTSVILCVL

SEQ ID NO: 109 - protein, 23 aa, Mus musculus
WKKYALDLGISVFTIIVVTLIMH

SEQ ID NO: 110 - protein, 62 aa, Mus musculus; identical to SEQ ID NO: 108

SEQ ID NO: 111 - protein, 23 aa, Mus musculus
WKKYALDLGISVFTIIVVTLIMH

SEQ ID NO: 112 - protein, 199 aa, Danio rerio
KKLVGFISAIPADIHIYDTLKRMVEINFLCVHKKLRSKRVAPVLIREITRRVNLEGIFQAVYTAGVVLPKPVSTCRYWHRSLNPRKLVEVKFSHLSRNMTLQRTMKLYRLPDSTRTPGLRTMGDRDVKQVTALLQKHLSQFHLRPVMGEEEVKHWFLPQENIIDTFVVEGSGGMLTDFISFYTLPSTVMHHPLHKSLKA

SEQ ID NO: 113 - protein, 97 aa, Danio rerio
IHIYDTLKRMVEINFLCVHKKLRSKRVAPVLIREITRRVNLEGIFQAVYTAGVVLPKPVSTCRYWHRSLNPRKLVEVKFSHLSRNMTLQRTMKLYRL

SEQ ID NO: 114 - protein, 926 aa, Bos taurus
MLRVSRTKLGRLSPSLSRGLHHKAVMALRREDVNAWERRAPLAPRHVKGITNLGYKVLIQPSNRRAIHDKEYVKAGGILQEDISEACLILGVKRPPEEKLMPKKTYAFFSHTIKAQEANMGLLDEILKQEIRLIDYEKMVDHRGIRVVAFGQWAGVAGIINILHGMGLRLLALGHHTPFMHIGMAHNYRNSGQAVQAVRDAGYEISLGLMPKSIGPLTFVFTGTGNVSKGAQEIFNELPCEYVEPHELKEVSQNGDLRKVYGTVLSRHHHLVRKTDGVYDPVEYDKYPERYISRFNTDIAPYTTCLINGIYWEQNTPRLLTRQDAQSLLAPGKSPVAGVEGCPALPHKLVAICDISADTGGSIEFMTECTTIERPFCMYDADQHIIHDSVEGSGILMCSIDNLPAQLPIESTEYFGDMLYPYVEEMILSDATQPLESQNFSPVVRDAVIASNGMLSNKYKYIQKLRENREHAQSLSMGTKKKVLVLGSGYVSEPVLEYLLRDDSIEITVGSDMKNQIEQLGKKYNINPVSLHVGKQEEKLSSLVATQDLVISLLPYVLHPLVAKACIASKVNMITASYITPALKELEKSVEDAGITVIGELGLDPGLDHMLAMETIDKAKEVGATIESYVSYCGGLPAPECSDNPLRYKFSWSPVGVLMNIMQPATYLLNGKVVNAVGGVSFLDSVTPMDYFPGLNLEGYPNRDSTKYAEIYGIPSAHTLLRGTLRYKGYAKALSGFVKLGLINRDAFPALQPDANPLTWKELLCDLVGISSSSKCDVLKEAVFKKLGGDTTQLEALEWLGLLGDEQVPQAESLVDALSKHLAVKLSYGPGEKDMIVMRDSFGIRHPSGHLENKTIDLVVYGDVNGFSAMAKTVGLPTAMAAKMLLDGEIQAKGLMGPFSKEIYGPILERIKAEGIMYTTQSTIKL

SEQ ID NO: 115 - protein, 134 aa, Bos taurus
QLGKKYNINPVSLHVGKQEEKLSSLVATQDLVISLLPYVLHPLVAKACIASKVNMITASYITPALKELEKSVEDAGITVIGELGLDPGLDHMLAMETIDKAKEVGATIESYVSYCGGLPAPECSDNPLRYKFSW

SEQ ID NO: 116 - protein, 121 aa, Bos taurus
HVGKQEEKLSSLVATQDLVISLLPYVLHPLVAKACIASKVNMITASYITPALKELEKSVEDAGITVIGELGLDPGLDHMLAMETIDKAKEVGATIESYVSYCGGLPAPECSDNPLRYKFSW

SEQ ID NO: 117 - protein, 349 aa, Danio rerio
MATPELMLSLGLIEKDVNADTLWVWCYPSIDADLREVMLRKCCLTLDNQVLHTFVFGQFCRTWYYITTVEVQEPTVLKKVTHFSIVVTAKDFNPEKYAAFSRVLCRTYMKHGSPVKMMEGYIAVLTKGICQSDENGSFLIKDYDVRKALLAGSLKDVVSQFGMETIILYTALMLKKRVVVYHPRIEALLEFTRALPCLVWHRKDWSILHPFVHLENDELENLKVCTGYVAGFVDPEVKDRSDLFDVFVNLPDSEITVSQNAKEAMSMGKLHKEIGNFIVQAAEDADRSDAQVIKDISVKTKEILSNLMSLADHADNSKLTLECLKQGHYPPATENFLFHLAAAEQLLKI

SEQ ID NO: 118 - protein, 95 aa, Danio rerio
TYMKHGSPVKMMEGYIAVLTKGICQSDENGSFLIKDYDVRKALLAGSLKDVVSQFGMETIILYTALMLKKRVVVYHPRIEALLEFTRALPCLVWH

SEQ ID NO: 119 - protein, 169 aa, Danio rerio
TIILYTALMLKKRVVVYHPRIEALLEFTRALPCLVWHRKDWSILHPFVHLENDELENLKVCTGYVAGFVDPEVKDRSDLFDVFVNLPDSEITVSQNAKEAMSMGKLHKEIGNFIVQAAEDADRSDAQVIKDISVKTKEILSNLMSLADHADNSKLTLECLKQGHYPPAT

SEQ ID NO: 120 - protein, 119 aa, Arabidopsis thaliana
LIKAVTTMADVRLGETIHSVVIRSGFGSLIYVQNSLLHLYANCGDVASAYKVFDKMPEKDLVAWNSVINGFAENGKPEEALALYTEMNSKGIKPDGFTIVSLLSACAKIGALTLGKRVH

SEQ ID NO: 121 - protein, 76 aa, Arabidopsis thaliana
LVAWNSVINGFAENGKPEEALALYTEMNSKGIKPDGFTIVSLLSACAKIGALTLGKRVHVYMIKVGLTRNLHSSNV

SEQ ID NO: 122 - protein, 119 aa, Danio rerio
LLTYLPGTTIAKITCSPQILYDVGKMAATLDTVLLQMEHPNTRVLQRERFIWKLTSIPLLNQYVHVMDGDPVQKIVKGVIEKYQVQVMPKLPLFRECINHGDFNDHNLLVKPDGPSKYK

SEQ ID NO: 123 - protein, 130 aa, Danio rerio
LLTYLPGTTIAKITCSPQILYDVGKMAATLDTVLLQMEHPNTRVLQRERFIWKLTSIPLLNQYVHVMDGDPVQKIVKGVIEKYQVQVMPKLPLFRECINHGDFNDHNLLVKPDGPSKYKISGILDFADMS

SEQ ID NO: 124 - protein, 274 aa, Staphylococcus phage
MPQGITKTSNQIIPEVLAPMMQAQLEKKLRFASFAEVDSTLQGQPGDTLTFPAFVYSGDAQVVAEGEKIPTDILETKKREAKIRKIAKGTSITDEALLSGYGDPQGEQVRQHGLAHANKVDNDVLEALMGAKLTVNADITKLNGLQSAIDKFNDEDLEPMVLFINPLDAGKLRGDASTNFTRATELGDDIIVKGAFGEALGAIIVRTNKLEAGTAILAKKGAVKLILKRDFFLEVARDASTKTTALYSDKHYVAYLYDESKAVKITKGSGSLEM

SEQ ID NO: 125 - protein, 311 aa, Xenopus tropicalis
MRLSWLLRKSFDFGEREVAHWFPGHMAKGLKQMKTKLKNLDCIVEVHDARIPLSGRNPIFQDSLGMKPHLLILNKMDLADLTQKKRILAQLKQQGVGNVIFTDCVKDQNIKHVVPVISELVGCSQRFHREENTETCIMVIGVPNVGKSSLINALRRMHLRKGKASRVGAEPGITRSVLTKIQVSESPLIFLFDTPGVLSPRIESVETGMKLALCGTILDHLVGEDIMADYLLYILNQQMQHRYVEHYGLEKPCADIETLLKRIALKLGKTQKVKAITGVGDVNITVPNYNAAAYDFIRTFRRGQLGVVMLD

SEQ ID NO: 126 - protein, 209 aa, Rattus norvegicus
MALLAEHLLKPLPADRQIETGPFLEAVAHLPPFFDCLGSPVFTPIKADISGNITKIKAVYDTDPAKFKTLQNILEVEKGMYGAEWPKVGATLALLWLKRGLRFIQVFLQSICDGERDENHPNLIRVNANKAYEMALKKYHGWLVQKIFKAALYAAPYKSDFLKALSKGQNVTEEECLEKIRLFLVNYTATIDAIYEMYTKMNAELDYTV

SEQ ID NO: 127 - protein, 520 aa, Rattus norvegicus
MAALKLLSSGLRLCASARNSRGALHKGCACYFSVSTRHHTKFYTDPVEAVKDIPNGATLLVGGFGLCGIPENLIGALLKTGVKDLTAVSNNAGVDNFGLGLLLRSKQIKRMISSYVGENAEFERQFLSGELEVELTPQGTLAERIRAGGAGVPAFYTSTGYGTLVQEGGSPIKYNKDGSVAIASKPREVREFRGQHFILEEAITGDFALVKAWKADRAGNVIFRKSARNFNLPMCKAAGTTVVEVEEIVDIGSFAPEDIHIPKIYVHRLIKGEKYEKRIERLSLRKEGEGKAKSGKPGEDVRERIIKRAALEFEDGMYANLGIGIPLLASNFISPNMTVHLQSENGVLGLGPYPLKDEADADLINAGKETVTVLPGASFFSSDESFAMIRGGHVNLTMLGAMQVSKYGDLANWMIPGKMVKGMGGAMDLVSSSKTKVVVTMEHSAKGNAHKIMEKCTLPLTGKQCVNRIITEKGVFDVDKKNGLTLIELWEGLTVDDIRKSTGCDFAVSPNLMPMQQIST

SEQ ID NO: 128 - protein, 159 aa, Helicoverpa assulta
TCPPKGLMDLAPCMKAPMYVSLPHFLDSDPALLTKVKGLNPDVTQHGIEIDYEPITGTPMVAKQRIQFNIQLLKTDKLDLFKDLSGDIVPLFWIDEGLSLNKTFVNMLKHQLFIPKRVVGVLRWWMVSFGSLGAVIGIVFHFRDHIMRLAVSGDTKVSK

SEQ ID NO: 129 - protein, 168 aa, Helicoverpa assulta
TCPPKGLMDLAPCMKAPMYVSLPHFLDSDPALLTKVKGLNPDVTQHGIEIDYEPITGTPMVAKQRIQFNIQLLKTDKLDLFKDLSGDIVPLFWIDEGLSLNKTFVNMLKHQLFIPKRVVGVLRWWMVSFGSLGAVIGIVFHFRDHIMRLAVSGDTKVSKVIPEVEEQK

SEQ ID NO: 130 - protein, 1133 aa, Mus musculus
MSPTQWDFPVELCCRPMAFVTLTGLDVVYNAVHRAVWDAFCANRRADRVPISFKVLPGDHEYPKCRSKRTSYEWYIPKGVLKTGWMNKHLNLVPALVVVFYELDWDEPQWKEKQSECATRVEIVRQSLQGRNTKVAVVLIQKKTPLPPGEDVIASERAAALCNVCELSGKSLFVLPHTDHLVGYIIRLENAFYEHAQTYYYTEIRRVKSHKEFLNKTTHQLLFVRHQFKIAFFSELKQDTQNALKNYRIAYNLVHELRAHETNILEIKTMAGFINYKICRLCFQHNTPLDAIAQFRKHIDLCKKKIGSAELAFEHAAWMAKQFQAFGDLFDEAIKLGLTAIQTQNPGFYYQQAAYYAQERKQHAKALCNHDAAVMYPNPDPLETQSGVLDFYGQRPWRQGILSFDLSDPEKEKAGILAIQLKERSVVHSEIIIALLSNAVAQFKKYKCPRMKSHLMVQMGEEYYYAKDYTKALKLLDYVMCDYRSEAWWTLLTSILTTALKCSYLMAQLKDYITYSLELLGRASTLKDEQKSRIEKNLMNVLMNESPDPEPDCDVLAVKTAQKLWADRVSLAGSNVFQIGVQDFVPFVQCKAKFHAPSFHVDVPVEFDVFLKADCPHPIRFSKLCVSFNNQVYNQFCVLEEASKASEVLENLTQGKMCLVPGKTRKLSFKFVAKTEDVGKKIEITSVDLFLGSESGRCVVLSWQGGGGDAASSQEALQAARSFKRRPKLAEDEIHWDSVIIQASTMIISRVPNISVHLRHEPPALMNEMYCLVVTVQSHEKSPIRDVKLTAGLKPGQDANLTQKTHVTLHGAELCDESYPALLTDIPVGDLHPGEQLEKTVYVRCGTVGSRMFLVYVSYLINTTVEGKEIICKCHKDDTVTIETVFPFDVAVRFVSTKFEHLERVYADIPFLLMTDVLSASPWALTIVSSELQLAPSMTAMDHLESQIDKVVLQTGESASECFCLRCPSAGNIEGGVATGHYIISWKRASVVESIPAVSTVITLPHVIAENIPLHVNADLPSFGRVRESLPVRYHLQNKTDLVQDVEISVEPSDAFMFSGLKQIRLRILPGTKQEMLYNFYPLMAGYQQLPSLNINLLRFPNFTNQLLRRFIPTSIFVKPQGRLLEDTSIAAA

SEQ ID NO: 131 - protein, 113 aa, Rattus norvegicus
VFSVDYSDELDILVSGSADFAVKVWALSAGTCLNTLTGHTEWVTKVVLQQCKVKSLLHSPGDYILLSADKYEIKIWPIGREINCKCLKTLSVSEDRSICLQPRLHFDGKYIVC

SEQ ID NO: 132 - protein, 125 aa, Rattus norvegicus
ADFAVKVWALSAGTCLNTLTGHTEWVTKVVLQQCKVKSLLHSPGDYILLSADKYEIKIWPIGREINCKCLKTLSVSEDRSICLQPRLHFDGKYIVCSSALGLYQWDFASYDILRVIKTPEVANLA

SEQ ID NO: 133 - protein, 182 aa, Rattus norvegicus
MLVLVLGDLHIPHRCNSLPAKFKKLLVPGKIQHILCTGNLCTKESYDYLKTLAGDVHIVRGDFDESLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKS

SEQ ID NO: 134 - protein, 186 aa, Rattus norvegicus
MAGHRLVLVLGDLHIPHRCNSLPAKFKKLLVPGKIQHILCTGNLCTKESYDYLKTLAGDVHIVRGDFDESLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKS

SEQ ID NO: 135 - protein, 189 aa, Rattus norvegicus
MAAKQPPPLMKKHSQTDLVSRLKTRKILGVGGEDDDGEVHRSKISQVLGNEIKFAVREPLGLRVWQFLSAMLFSSVAIMALALPDQLYDAVFDGAEVTSKTPIRLYGGALLSISLIMWNALYTAEKVIIRWTLLTEACYFGVQSLVVTATLAETGLMSLGTLLLLASRLLFVIVSIYYYYQVGRKPKKV

SEQ ID NO: 136 - protein, 964 aa, Sus scrofa
MDAPSAGYAFEYLIETLNDSSHKKFFNVPRLGGTKYDVLPYSIRVLLEAAVRNCDGFLMKKEDVMNILDWKTKQSNVEVPFFPGRVLLQDFTGIPAMVDFAAMREAVKTLGGDPKKVHPACPTDLTVDHSLQIDFNKCAIQNAPNPGGGDLQKAGKLSPLRVQPKKLPCRGQTACRGSCDSGDLGRNSGKFSSQIENTPILCPFHLQPVPEPETVLKNQEVEFGRNRERLQFFKWSSRVFKNVAVIPPGTGMAHQVNLEYLSRVVFEEKDLLFPDSVVGTDSHITMVNGLGILGWGVGGIETEAVMLGLPVSLTLPEVVGCELTGSSNPFVTSIDVVLGITKHLRQIGVAGKFVEFFGSGVSQLSIVDRTTIANMCPEYGAILSFFPVDNVTLKHLEYTGFNKAKLKSMETYLKAVKLFRNDQDNSGEPEYSQVIQINLNSIVPSVSGPKRPQDRVAVTDMKSDFQACLNEKVGFKGFQIAAEKQNDTVSIHYEGSEYKLSHGSVVIAAVISCTNNCNPSVMLAAGLLAKKAVEAGLRVKPYIRTSLSPGSGMVTHYLSSSGVLPYLSKLGFEIVGYGCSTCVGNTAPLSEAVLNAVKQGDLVTCGVLSGNKNFEGRLCDCVRANYLASPPLVVAYAIAGTVNIDFRTEPLGTDPTGKNIYLHDIWPSREEVHQIEEEHVVLSMFKALKEKIEMGNKRWNSLEAPDSVLFPWDLKSTYIRCPSFFDKLTKEPVALQPIENAHVLLYLGDSVTTDHISPAGSIARSSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLQFLPGENADSLGLSGRETFSLTFPEELSPGVTLNIKTSTGKIFSVIASFENDVEIILYKHGGLLNFVARKFS

SEQ ID NO: 137 - protein, 387 aa, Drosophila yakuba
MTSHPVFIDLSLDEQVQELRKYFKKLGAEISSEKSNKGVEDDLHKIIGVCDVCFKDGEPSQIDGILNSIVSIMITIPLDRGENIVLAYCEKMTKAPNLPLGKVCLQSLWRLFNNLDTASPLRYHVYYHLVQVAKQCEQVLEVFTGVDQLKSQFANCPPSSEQMQKLYRLLHDVTKDTNLELSSKVMIELLGTYTADNACVAREDAMKCIVTALADPNTFLLDPLLALKPVRFLEGDLIHDLLSIFVSEKLPAYVQFYEDHREFVNSQGLNHEQNMKKMRLLTFMQLAESSPEMTFETLTKELQINEDEVEPFVIEVLKTKLVRARLDQANHKVHITSTMHRTFGAPQWEQLRDLLQAWKENLSTVREGLTSVSSAQVDLARSQKLIH

SEQ ID NO: 138 - protein, 339 aa, Rattus norvegicus
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPHAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTALKIAEANKLKLTPEYLQLMKYKAIASNSKIYFGKDIPNMFMDSAGGLGKQSEGLSDKLGFGLEDEPLETATKDN

SEQ ID NO: 139 - protein, 749 aa, Lotus japonicus
MRKECHPLLRGGRKDNKFRQGFSSSEMESLASICEVILPPLPMDALKIKKHDDVSIEDVEFFWNTSASHYPIPHEVAEILSKRSLIEAVILIRVVLWLLATRLGTFLLCGLLCFSEKWPFINNFSSMSLKKRERVMQWWLKNRFITPIRLAFAYLKVLCLFAYFTWVDENGDNPAWKAIGYEVSADEKLPNSSNGRLLEKGIVETMHETNSTLQQSLTEKGLNVTLDSRNNILKVKCDAIVVGSGCGGGVAASVLSGAGHKVVVLEKGNYFAPRDYSSLEGPSMDQLYETGGILASVDSRILLLAGSTVGGGSAVNWSACIKTPHEVLKEWSENHNLSLFSTSEYLSAMETVCERIGVTESCTHEGFQNQVLRKGCQNLGLKVDYVPRNSSGNHFCGSCGYGCPKGEKQGTQDTWLVDAVENGAVIITGCKAERFLLENNRNGSGRKKKCLGVLAKALSSRVTMKLQIEAKVTISAGGALLTPPLMISSGLKNKNIGKNLHLHPVLMTWGYFPESTSELKGKIFEGGIITSVHKVPSRDSNSYSDTRAIIETPSLGPGSFASLCPWESGLDFKERMLNYPRTAHLITIIRDKACGQVTTEGRVSYKLSAFDKENMKCGLQQALRILKAAGAVEVGTHRSDGQRVKCGEVSENEMAEFIDSVCPMEGALSPGENWNIYTSAHQMGSCRMGMNEKEGAVDENGESWEAQGLFVCDASLLPTAVGVNPMITIQSTAYCISNRVVDYLKRDQI

SEQ ID NO: 140 - protein, 186 aa, Salmo salar
MESFSSKDMAMKAQKKILSHMASKSMVQMLIDDTSSEILDELYRISKEHSGNRTEAQKVVKDLVKVVVKVGVLFRHNRFSKEELSLAQDFKKKLHQGVMTAISFQEVEFTFDKAVMTELLTDCRDILLKLVEKHLTLKSFGRIRHVFNHYSDPDLLTNLYTPGGPLWPNLTKICNGLNKLVEEGKL

SEQ ID NO: 141 - protein, 200 aa, Salmo salar
MAKIELKPVGTNLLKSVSGESVELQSLWRDKPVVLFFLRRFGCQVCRWTAAEISKLEPDLTAHGIALVGIGPEETGLKEFKEGGFFKGDLYIDEKKQCYKDLGFKRYTALSVVPAALGKKIREVTTKAKAQGIQGNFTGDLLQSGGMLIVAKGGEKVLLHFVQDSPGDYVPLEDISKALDISANVQAGERPQCNDDVCTR

SEQ ID NO: 142 - protein, 78 aa, Leishmania tarentolae
KGDFRSGLGVLSVINGEFEGCHLAIKKLKKAFQLKVGDVLLFDTSLEHGNTEVINPEIHWQRTSIVCYLRTGLMSSVC

SEQ ID NO: 143 - protein, 56 aa, Leishmania tarentolae
AIKKLKKAFQLKVGDVLLFDTSLEHGNTEVINPEIHWQRTSIVCYLRTGLMSSVCE

SEQ ID NO: 144 - protein, 303 aa, Oryza sativa
MAGMSLQHPWAFAFGLLGNIISFMTYLAPLPTFYRIYKSKSTQGFQSVPYVVALFSAMLWIYYALLKSDECLLITINSAGCVIETIYIAVYLVYAPKKAKMFTAKLLLLVNVGVFGLILLLTLLLSAGDRRIVVLGWVCVGFSVSVFVAPLSIIRLVVRTKSVEFMPFSLSFSLTISAVVWFLYGLLIKDKYVALPNVLGFSFGVIQMGLYAMYRNSTPKAVLTKEVEAATATGDDDHSAAGVKEHVVNIAKLSAAVDVVKTREVHPVDVESPPAEAPPQEDDKAAAATAAAVAGAGEKKVAA

SEQ ID NO: 145 - protein, 232 aa, Oryza sativa
MAPSLLGGFTKSLAMTVLSEIGDKTFFAAAILAMRYPRKLVLAGCLTSLTVMTALSVSLGWVAPNLISRKWTHHVTTLLFFVFGILSLWEGFKEDGDSEELAEVEAELDANFKSNKAESKSKSKANDDKKKQQRPFVLQFFSPIFIKAFSITFFGEWGDKSQIATIGLAADENPFGVVLGGVLAQALCTTAAVMGGKSLASQISEKMVGLSSGVLFLLFGIMSYLSGPEGEL

SEQ ID NO: 146 - protein, 203 aa, Oryza sativa
MAPSLLGGFTKSLAMTVLSEIGDKTFFAAAILAMRYPRKLVLAGCLTSLTVMTALSVSLGWVAPNLISRKWTHHVTTLLFFVFGILSLWEGFKEDGDSEELAEVEAELDANFKSNKAESKSKSKANDDKKKQQRPFVLQFFSPIFIKAFSITFFGEWGDKSQIATIGLAADENPFGVVLGGVLYELHLLFPLHFLNGLLCGPD

SEQ ID NO: 147 - protein, 203 aa, Ricinus communis
MALVNAEKPEVGSSPSSLGPRNKSWVLLMLRFVAFLATAAATIVMAANRETKTFVVATIGSTPIKATVTAKFQHTPAFVFFVIANGMGSIHNLVMIAGDTFVRKFDYKGLRWVTVAILDMLTAALISGGVNAAVFMAELGKNGNSHAKWNKICDRFGSFCDHGGAAIIASFIGLLLMLVISIISIIKLLKPKSPLVDSHVLAP

SEQ ID NO: 148 - protein, 153 aa, Arabidopsis thaliana
PLSVRKKVVSGICIGIASLLLIIIVASLCWFMKRKKKNNASDGNPSDSTTLGMFHEKVSYEELHSATSRFSSTNLIGSGNFGNVFKGLLGPENKLVAVKVLNLLKHGATKSFMAECETFKGIRHRNLVKLITVCSSLDSEGNDFRALVYEFMP

SEQ ID NO: 149 - protein, 130 aa, Arabidopsis thaliana
VRKKVVSGICIGIASLLLIIIVASLCWFMKRKKKNNASDGNPSDSTTLGMFHEKVSYEELHSATSRFSSTNLIGSGNFGNVFKGLLGPENKLVAVKVLNLLKHGATKSFMAECETFKGIRHRNLVKLITV

SEQ ID NO: 150 - protein, 346 aa, Brachyspira hyodysenteriae
MRKTVKIITSLVLIACLFLLASCANKGSSSSGDATTLKVAVMPFLNSVPIEYMINNKLDEKYGFKIETVYFPSGGPMNEALGAGLWEVGTLSAASVYSLANYNAHVVADIGHSEGGIEVLVNPDSDILTVKGVNKDFPEVYGDAATLKGKTIAVPTGTISHLNVIHWLRAINVDPNTVNIVHMEFPQAYQALKAKKIDAAALNPPTSFSAEADGMKIVSSLTTLNIPQYDSIIVSDEAFNNKKDTIVLYIKAFLEACDALQADPNMAAQELLNWYTKNGSTSTLEACQSEVQTRPFVTTEEIKNIKTGDSVRITADFFASQSLITEDKLTVVDQNVDTELLGKALN

SEQ ID NO: 151 - protein, 108 aa, Bacillus subtilis
GLIAGATGSGKSVCINTILVSLLYKADPSEVKVLLIDPKMVELAPYNKIPHLVSPVITDAKAATAALKWVVEEMERRYELFAHSGVRDIDRFNQLTAEHQMGEKLPYL

SEQ ID NO: 152 - protein, 77 aa, Bacillus subtilis
TGSGKSVCINTILVSLLYKADPSEVKVLLIDPKMVELAPYNKIPHLVSPVITDAKAATAALKWVVEEMERRYELFAH

SEQ ID NO: 153 - protein, 117 aa, Papaver bracteatum
AEEASHELYCERAQIKDGQTVLDIGCGQGGLVLYVAQKYKNCHVTGLTNSKEQVNYILKQAEKLGLRNVDVILADVTQYESDKTYDRILVIGVVEHMKNMQLFIKKLSTWMAEDSLL

SEQ ID NO: 154 - protein, 71 aa, Papaver bracteatum
ILKQAEKLGLRNVDVILADVTQYESDKTYDRILVIGVVEHMKNMQLFIKKLSTWMAEDSLLFVDHSCHKTF

SEQ ID NO: 155 - protein, 172 aa, Arabidopsis thaliana
MDHVNPTLFHLKSLSIFTLTLLYISSPHFLLFKTLSMYENLRIFLKIIPFNLFGMKSVSLIAILLLHLFVSSDTFQLDLFHCKYYLAITWLINRDNECVIYILVGSFICCIVICEVVDKASGSSIPDCSNACGPCKPCKLVVISSTCSASEACPLVYKCLCKGKYYHVPSLT

SEQ ID NO: 156 - protein, 188 aa, Glycine max
MEGVESKEREVMVAKPVAVVGVCDLLLRLLAFTVTLVAAIVIAVDKQTKLVPIQLSDSFPPLNVPLTAKWHQMSAFVYFLVTNAIACTYAAMSLLLALVNRGKSKGLWTLIAVLDTFMVALLFSGNGAAAAVGILGYKGNSHVNWNKVCNVFGKFCDQMAASIGVSLIGSLAFLLLVVIPVVRLHRRT

SEQ ID NO: 157 - protein, 194 aa, Glycine max
MASENGDKLELAFSAVPDPKPKKDWVILSLRVVAFFATASATLVMAFNKQTKGMVVATIGTNPVTITLTAMFQHTPAFIFFVIVNAIASFYNLLVIGVEILGPQYDYKGLRLGLIAILDVMTMALAATGDGAATFMAELGRNGNSHARWDKICDKFEAYCNRGGVALVASFVGLILLLVVTVMSITKLLKLNRI

SEQ ID NO: 158 - protein, 108 aa, Lotus japonicus
KRIASVLCNHENGSIFKALEECLKSNSLKMAKSCLVLATWLTRMLYTLPDTGVRDVARKSLLEEVIKVLHSSKSLEDMILVTLSLYPFISDPTVHEVLRVYAKSIYRI

SEQ ID NO: 159 - protein, 179 aa, Lotus japonicus
TVAADILKALLNLNSVDVTELWSCKEVVELDLSSNGEVLSLHYLNGQVLSGLMDGTSKVCDARKRIPRVIQETHEHTKAVTSLCSSGDRLYSASLDKTIRVWTIKSDGIKCIDVYDIKEAVHELAANDKLACYVSQGTGVKVFNWSEAPKLINFSKYVKSLAVAGDKLYCGCSGYSIQE

SEQ ID NO: 160 - protein, 953 aa, Sus scrofa
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDSNEAAAADVLEFVREAIQRFDNLRMLIVEKMLEVFHAIKSVKIYRGALWILGEYCSTKEDIQSVMTEVRRSLGEIPIVESEIKKEAGELKPEEEITVGPVQKLVTKMGTYATQSALSSSRPTKKEEERPPLRGFLLDGDFFVAASLATTLTKIALRYVALVQEKKRQNSFVAEAMLLMATILHLGKSSPPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNIIDLNDYLQHILKSTNMKCLTPEKALSGYCGFMAANLYARSIFGEDALANVSIEKPIQQGPEAPVTGHIRIRAKGQGMALSLGDKINLSQKKTSI

SEQ ID NO: 161 - protein, 140 aa, Rattus norvegicus
ILGFDSEGNVVNKPDSHGGSLEWTKICEKSSKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNF

SEQ ID NO: 162 - protein, 84 aa, Rattus norvegicus
LEWTKICEKSSKVITFIDLAGHEKYLKTTVFGMTGHLPDFCMLMVGSNAGIVGMTKEHLGLALALNVPVFVVVTKIDMCPANIL

SEQ ID NO: 163 - protein, 927 aa, Xenopus tropicalis
MEDPVQLKEEGNKYFQSNEYGQAIQCYSKALKLITDKKMQAVLYRNRSACYLKQDNYVQAAADASKAIDVDASDIKALFRRCQALEKLGKLDQAYKDVQRCATLEPKNRTFLETLHRLGTNIQEKLHVQFSTDSRVHKMFEILLDKNSEKEKREKAANNLIVLGREDAGAEQIFQNNGVNLLMQLIESKDPEMILSAIRTLSGMCTGHRARATAIVHLVGINKICSIMAVDNEEIALAACNLLQNIVDSLTGEDKKAHGKQEALVLDTKKDLKIITTHLLDMLVSKKVSGHGRDQALNLLNKNIPRYDLKNKDNSKSLFVVDAGLKKILKVLGQVPELPNCLPLTPNTRLNASVLVNKLYDDLRCDPERDNFRIICEEYITGSFDPKDMEKNLHAIQTVSGILQGPFDLGNKLLSLQGVMEMMVALTGSENEVDQLVAVEALIHASTKLSRASFIITNGVSLLKDIYKKTKNEKIKIRALVGLCKLGSAGGTDYALRQFAEGSTDKLAKQCRKWLCNPSLDIQTRKWAVEGLAYLTLDADVKDEFVEDEQSLKAMFELSKTSDKTILYSVATTLVNCTNSYDVKEVIPEMVQLAKFSKQHVPEQHPKDKKDFVEKRVKRLLKADVISALSCMVKADNSILTDQTKEQLSRVFLALCEDPKDRGIIVAQGGGKAMIPLALEGTDVGKIKASHGLAKIAAVSNPDIAFPGERVYEVVRPLVSLLNTERDGIQNFEALLALTNLSGKNDKLRQKIIKEKALPEIENYMFENHEQIRQAATECMCNLALNKEVKERFMAEGNDRLKLIILLCGEEDEVKLQRAAAGTLAMLTGAEKKLCHKMTEVTTQWMEILQRLCLSEDLQVQHRGVVIAYNLINADKELAKKLVESEMLEILTVIGKQADVPNKQHIINAAREALVKCLDYGFIKTVS

SEQ ID NO: 164 - protein, 321 aa, Bacillus subtilis
MIFLFRALKPLLVLALLTVVFVLGGCSNASVLDPKGPVAEQQSDLILLSIGFMLFIVGVVFVLFTIILVKYRDRKGKDNGSYNPKIHGNTFLEVVWTVIPILIVIALSVPTVQTIYSLEKAPEATKDKEPLVVHATSVDWKWVFSYPEQDIETVNYLNIPVDRPILFKISSADSMASLWIPQLGGQKYAMAGMLMDQYLQADEVGTYQGRNANFTGEHFADQEFDVNAVTEKDFNSWVKKTQNEAPKLTKEKYDQLMLPENVDELTFSSTHLKYVDHGQDAEYAMEARKRLGYQAVSPHSKTDPFENVKENEFKKSDDTEE

SEQ ID NO: 165 - protein, 174 aa, Drosophila melanogaster
EHDNECFCVDKLANVIKRKNGCLYAGALDLTTCLDAPVILTLPHMLGASNEYRKMIRGLKPDAKKHQTFVDVQSLTGTPLQGGKRVQFNMFLKSINRIGITENLPTVLMPAIWVEEGIQLNGEMVAFFKKKLINTLKTLNIVHWATLCGGIGVAVACLIYYIYQRGRVVEPPVK

SEQ ID NO: 166 - protein, 36 aa, Drosophila melanogaster
VAFFKKKLINTLKTLNIVHWATLCGGIGVAVACLIY

SEQ ID NO: 167 - protein, 174 aa, Drosophila melanogaster; identical to SEQ ID NO: 165

SEQ ID NO: 168 - protein, 36 aa, Drosophila melanogaster; identical to SEQ ID NO: 166

SEQ ID NO: 169 - protein, 122 aa, Plutella xylostella
EHGIEIDFEPISGTPMVANQRVQFNMQLLKHDKVELLNNLPDTIVPLFWIDEGLALNKTFVNMLKFQLFYPKKAVGVIKWLLVTFGGFGLIGCTIYHYKDRIMSFASSPGSAAVTKVKPEEV

SEQ ID NO: 170 - protein, 37 aa, Plutella xylostella
VNMLKFQLFYPKKAVGVIKWLLVTFGGFGLIGCTIYH

SEQ ID NO: 171 - protein, 199 aa, Thellungiella halophila
MSYLGVGLSPVNVAGTKMKLMDRKVRLTELILRCSVCALALVAAILIATDTQVKEIFTIQKKAKYTDMKALVFLVVVNGIAAAYSLLHMVRCVVGMMKGSVLFSKPLAWAIFSGDQAIAYLTVAGVAAAAQSAAFAKLGEPELQWMKICTIYGKFCNQVGEGIATALLASIGMVLISSISAFALFRLYGGNKAQQGSRW

SEQ ID NO: 172 - protein, 141 aa, Protobothrops mucrosquamatus
VNEMYKPLNVAITLSLLRIWSTRDLITVQSDSKVTLGSFGDWRKTVLLKQQSHDCAHLLTDITFTKNVIGVAYKKGMCDPKLSVGLVQDYSSNVFVVAAIMTHELGHNLGMEHDEDENGKKCKCDTCIMSPAISDPPAQLF

SEQ ID NO: 173 - protein, 100 aa, Protobothrops mucrosquamatus
MYKPLNVAITLSLLRIWSTRDLITVQSDSKVTLGSFGDWRKTVLLKQQSHDCAHLLTDITFTKNVIGVAYKKGMCDPKLSVGLVQDYSSNVFVVAAIMTH

SEQ ID NO: 174 - protein, 64 aa, Danio rerio
AFIKKEALVLAKIMKLPSFPTISQDCLFHPVPLTVRYLLEANLPDALHVWVQKVITGAGMDSDS

SEQ ID NO: 175 - protein, 91 aa, Danio rerio
IKKEALVLAKIMKLPSFPTISQDCLFHPVPLTVRYLLEANLPDALHVWVQKVITGAGMDSDSFLTFDPTDKKPHLLSYDVQAVAVIIVAMK

SEQ ID NO: 176 - protein, 200 aa, Arabidopsis thaliana
LHRMNHKNISAWNMKRLMKIVRNVSLTTLDEQMLESTYEDESTRQIRSEKEAKAAARKIFKNVEQRGAKYIYLEDLMRFLREDEAMKTMGLFEGAPENKRISKSALKNWLVNAFRERRALALTLNDTKTAVNKLHHMINIVTAIVIVVIWLVLLEIASSKVLLFVSSQVVLLAFIFGNTVKTVFESIIFLFIVHPYDVGD

SEQ ID NO: 177 - protein, 161 aa, Arabidopsis thaliana
VTYLKILDLEDKIKELKVIHVAGTKGKGSTCVFSEAILRNCGFRTGMFTSPHLIDVRERFRIDGLDISEEKFLQYFWECWKLLKEKAVDGLTMPPLFQFLTVLAFKIFVCEKVDVAVIEVGLGGKLDSTNVIQKPVVCGIASLGMDHMDILGNTLADIAFH

SEQ ID NO: 178 - protein, 171 aa, Arabidopsis thaliana
FQFLTVLAFKIFVCEKVDVAVIEVGLGGKLDSTNVIQKPVVCGIASLGMDHMDILGNTLADIAFHKAGIFKPQIPAFTVPQLSEAMDVLQKTANNLEVPLEVVAPLEPKKLDGVTLGLSGDHQLVNAGLAVSLSRCWLQRTGNWKKIFPNESKETEIPVAFCRGLATARLH

SEQ ID NO: 179 - protein, 121 aa, Bos taurus
VGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGC

SEQ ID NO: 180 - protein, 177 aa, Bos taurus
MVHAETFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAV

SEQ ID NO: 181 - protein, 356 aa, Mus musculus
MCAEDAEWKGSSAIQLPHMVVYATFTPLYLFENKIFSLEKMANSAEKLREYGLSHICSHPVLVTRSRSCPLVSPPKPPPLPAWKLIRHKKETVITDEAQDAVPKKPEQFLEISSPFLNYRMTPFTIPTETHFVQSVIKKGTPLGSSLPPLVENDLVASTSQGEMSIVNGNQSQGNIALQITLGKDEPSEPALADFHQLEATSLDRDLISLTTATLDKSQEELAINEGVAKEIWLDFEDFCVCFHHIYIFHKPHSYCLNFQKSEFKFVEERVPYYLFVDSLKPIELLVCFSALVRWGESGALTKDSPPVEPGLLTAEAITWKSLKPLSVVLRIHTYATKASVVRLPAGYGLTSCFLV

SEQ ID NO: 182 - protein, 108 aa, Caenorhabditis elegans
HVVAASKAMLNGDWKKCQDYIVNDKMNQKVWNLFHNAETVKGMVVRRIQEESLRTYLLTYSTVYATVSLKKLADLFELSKKDVHSIISKMIIQEELSATLDEPTDCLI

SEQ ID NO: 183 - protein, 71 aa, Caenorhabditis elegans
MNQKVWNLFHNAETVKGMVVRRIQEESLRTYLLTYSTVYATVSLKKLADLFELSKKDVHSIISKMIIQEEL

SEQ ID NO: 184 - protein, 36 aa, Sus scrofa
EVAGRDPKLYAMHPWVTSKPLPEYLLKKITNNCVFI

SEQ ID NO: 185 - protein, 29 aa, Sus scrofa
LYAMHPWVTSKPLPEYLLKKITNNCVFIV

SEQ ID NO: 186 - protein, 382 aa, Sus scrofa
MGPIGAEADENQTVEEMKMEPSGPGHTTPRGELAPDSEPELKDSTKLIEVQIILILAYCSIILLGVVGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYARIWSKLKNHVSPGGVNDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSMTSKAKKNLEATKNGGPDDSFTEATNV

SEQ ID NO: 187 - protein, 391 aa, Perilla frutescens
MVTVEDIRRAQRAEGPATVMAIGTATPENCVDQSTYPDYYFRITNSEHRTDLKEKFKRMCEKSMIRKRYMHLTEEFLKENPNMTAYMAPSLDARQDIVVVEVPKLGKEAAQKAIKEWGQPKSKITHLVFCTTSGVDMPGADYQLTKLLGLRPSVKRFMMYQQGCFAGGTVLRMAKDLAENNAGARVLVVCSEITAVTFRGPSESHLDSLVGQALFGDGAAAVIVGSDPVVGVERPLFQLVSAAQTILPDSDGAIDGHLREVGLTFHLLKDVPGLISKNIEKSLKEAFGPLGISDWNSVFWIAHPGGPAILDQVEAKLGLKPEKLRSTRHVLGEYGNMSSACVLFILDEMRKSSAKEGMSSTGEGLDWGVLFGFGPGLTVETVVLHSVPINN

SEQ ID NO: 188 - protein, 317 aa, Arabidopsis thaliana
MAVKATKAEKKIVYDSKLCQLLNEYSQILVVAADNVGSTQLQNIRKGLRGDSVVLMGKNTMMKRSVRIHADKTGNQAFLSLLPLLQGNVGLIFTKGDLKEVSEEVAKYKVGAPARVGLVAPIDVVVQPGNTGLDPSQTSFFQVLNIPTKINKGTVEIITPVELIKKGDKVGSSEAALLAKLGIRPFSYGLVVESVYDNGSVFNPEVLNLTEDDLVEKFAAGVSMITALSLAISYPTVAAAPHMFLNAYKNVLAVALATEYSFPQAENVKEFLKDPTKFAVAVAAPVSGESGGAVVAVAVEEEAAEESDGDMGFDLFG

SEQ ID NO: 189 - protein, 193 aa, Brassica campestris
MFVIDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPYAASEDELRYHLGLSNFTTGKGKVDLVGSNVRPLEVFMCSIVRKMGYGEGFKWLSQYIK

SEQ ID NO: 190 - protein, 88 aa, Perilla frutescens
ATKILSVLSIGLGLEKGRLEKEVGGAEDLIVQMKINFYPKCPQPELALGWEAHTDVSALTFILHNMVPGLQLFYEDKWVTAKCVPNSI

SEQ ID NO: 191 - protein, 65 aa, Perilla frutescens
TDVSALTFILHNMVPGLQLFYEDKWVTAKCVPNSIIMHIGDTLEILSNGKYKSILHRGLVNKEKV

SEQ ID NO: 192 - protein, 368 aa, Clarkia breweri
MGSTGNAEIQIIPTHSSDEEANLFAMQLASAAVLPMALKAAIELDVLEIMAKSVPPSGYISPAEIAAQLPTTNPEAPVMLDRVLRLLASYSVVTYTLRELPSGKVERLYGLAPVCKFLTKNEDGVSLAPFLLTATDKVLLEPWFYLKDAILEGGIPFNKAYGMNEFDYHGTDHRFNKVFNKGMSSNSTITMKKILEMYNGFEGLTTIVDVGGGTGAVASMIVAKYPSINAINFDLPHVIQDAPAFSGVEHLGGDMFDGVPKGDAIFIKWICHDWSDEHCLKLLKNCYAALPDHGKVIVAEYILPPSPDPSIATKVVIHTDALMLAYNPGGKERTEKEFQALAMASGFRGFKVASCAFNTYVMEFLKTA

SEQ ID NO: 193 - protein, 677 aa, Arabidopsis thaliana
MKERDSESFESLSHQVLPNTSNSTHMIQMAMANSGSSAAAQAGQDQPDRSKWLLDCPEPPSPWHELKRQVKGSFLTKAKKFKSLQKQPFPKQILSVLQAIFPIFGWCRNYKLTMFKNDLMAGLTLASLCIPQSIGYATLAKLDPQYGLYTSVVPPLIYALMGTSREIAIGPVAVVSLLISSMLQKLIDPETDPLGYKKLVLTTTFFAGIFQASFGLFRLGFLVDFLSHAAIVGFMGGAAIVIGLQQLKGLLGITNFTTNTDIVSVLRAVWRSCQQQWSPHTFILGCSFLSFILITRFIGKKYKKLFWLPAIAPLIAVVVSTLMVFLTKADEHGVKTVRHIKGGLNPMSIQDLDFNTPHLGQIAKIGLIIAIVALTEAIAVGRSFAGIKGYRLDGNKEMVAIGFMNVLGSFTSCYAATGSFSRTAVNFAAGCETAMSNIVMAVTVFVALECLTRLLYYTPIAILASIILSALPGLININEAIHIWKVDKFDFLALIGAFFGVLFASVEIGLLVAVVISFAKIILISIRPGIETLGRMPGTDTFTDTNQYPMTVKTPGVLIFRVKSALLCFANASSIEERIMGWVDEEEEEENTKSNAKRKILFVVLDMSSLINVDTSGITALLELHNKLIKTGVELVIVNPKWQVIHKLNQAKFVDRIGGKVYLTIGEALDACFGLKV

SEQ ID NO: 194 - protein, 46 aa, Arabidopsis thaliana
YKKLFWLPAIAPLIAVVVSTLMVFLTKADEHGVKTVRHIKGGLNPM

SEQ ID NO: 195 - protein, 53 aa, Arabidopsis thaliana
KKLFWLPAIAPLIAVVVSTLMVFLTKADEHGVKTVRHIKGGLNPMSIQDLDFN

SEQ ID NO: 196 - protein, 377 aa, Arabidopsis thaliana
MIKTLVSPYSGFGSQKLKFDRSSEKVKTRAVRMELTITQPDDWHLHLRDGDLLHAVVPHSASNFKRAIVMPNLKPPVTSTAAAIIYRKFIMKALPSESSFDPLMTLYLTDKTLPEEIRLARESGVVYAVKLYPAGATTNSQDGVTDLFGKCLPVLEEMVKQNMPLLVHGEVTDPSIDVFDREKIFIETVLQPLIQRLPQLKVVMEHITTMDAVNFVESCKEGSVGATVTPQHLLLNRNALFQGGLQPHNYCLPVLKREIHREAIVKAVTSGSKKFFLGTDSAPHERSRKESSCGCAGIYSAPIALSLYAKVFDEAGALDKLEAFTSFNGPDFYGLPRNSSKITLKKSPWKVPDVFNFPFGEIVPMFAGETLQWQPLK

SEQ ID NO: 197 - protein, 229 aa, Bacillus subtilis
MTILAIDTSNYTLGIALLREDTVIAEYITYLKKNHSVRAMPAVHSLLNDCDMAPQDLSKIVVAKGPGSYTGVRIGVTLAKTLAWSLDIPISAVSSLETLAANGRHFDGLISPIFDARRGQVYTGLYQYKNGLLEQVVPDQNVMLADWLEMLKEKDRPVLFLGHDTSLHKQMIEDVLGTKGFIGTAAQHNPRPSELAFLGKEKEAADVHGLVPDYLRLAEAEAKWIESQK

SEQ ID NO: 198 - protein, 314 aa, Bacillus subtilis
MAKGIMLHEVGEQVDQYLLIKSSTKGIASNGKPFLTLMLQDQSGDIEAKLWDAKQSDEVTYAPQTIVKVVGDVHHYRGRTQLKLRNIRPVSEQENVNIDDFLETAPIPKNEMMDTITQYIFEMKNPNIQRITRFLVKKHEAEFMDYPAATKNHHEFVSGLAYHVVSMLNLAKAIADLYPSLDRDLLYAGVILHDLGKVKELSGPVSTSYTVEGNLLGHISIMVTELSKAAEELQIDSEEVLILQHLILSHHGKAEWGSPKPPMVKEAEILHYIDNLDAKMNMMDRALERVKPGEYTERVFALENRSFYKPTFHK

SEQ ID NO: 199 - protein, 419 aa, Bacillus subtilis
MNKFWIMLSHTYKNKIMAKSFIISTVITVLLVLVVTNLESIISLFQGDDAKEKIAVVDETNELYPVFSKQLKAVDTDGDLDVKLSKQSEDEVTKQVKDESLDGMLIIKRDEKGTISGTYKALTISDESTYQTLQQALTQTKTAVGTAELGVSQETISSLYAPVTVGQKALKEGAKSEEELGQTVGLVYIMLFVIYFSVIMYASMIAMEVATEKSSRVMEILISSMPPIQQMFAKLLGIGLVGITQLAIIIGAGSLSLKLNQKSETASSVGGFLNLTDVSATTVIYAVIFFLLGYFLYATLAAFLGSVVSRIEDVQQTITPMTLLVVAGFMIAMFGLNAPDAGFITVTSFIPFFTPMIMFLRVGMLDIPFWQAAVGIGITLLTIVILAVIGARIYKGGVLIYGNSSAFKAIKQALRLAKN

SEQ ID NO: 200 - protein, 174 aa, Bacillus subtilis
MNMLVINGTPRKHGRTRIAASYIAALYHTDLIDLSEFVLPVFNGEAEQSELLKVQELKQRVTKADAIVLLSPEYHSGMSGALKNALDFLSSEQFKYKPVALLAVAGGGKGGINALNNMRTVMRGVYANVIPKQLVLDPVHIDVENATVAENIKESIKELVEELSMFAKAGNPGV

SEQ ID NO: 201 - protein, 288 aa, Bacillus subtilis
MSKQLLALNIDGALLRSNGKIHQATKDAIEYVKKKGIYVTLVTNRHFRSAQKIAKSLKLDAKLITHSGAYIAEKIDAPFFEKRISDDHTFNIVQVLESYQCNIRLLHEKYSIGNKKKVNSNLLGKALIHPSDPIFYPVQFVESLSDLLMDEPVSAPVIEVYTEHDIQHDITETITKAFPAVDVIRVNDEKLNIVPKGVSKEAGLALVASELGLSMDDVVAIGHQYDDLPMIELAGLGVAMGNAVPEIKRKADWVTRSNDEQGVAYMMKEYFRMQQRKGFLDKFHMKRV

SEQ ID NO: 202 - protein, 97 aa, Mus musculus
MVSTSIPEVKALRSSVSDYGNYDIIVRHYNYTGKLNIGAEKDHGIKLTSVVFILICCFIILENIFVLLTIWKTKKFHRPMYYFIGNLALSDLLAGVA

SEQ ID NO: 203 - protein, 28 aa, Mus musculus
VVFILICCFIILENIFVLLTIWKTKKFH

SEQ ID NO: 204 - protein, 140 aa, Mus musculus; identical to SEQ ID NO: 161

SEQ ID NO: 205 - protein, 84 aa, Mus musculus; identical to SEQ ID NO: 162

SEQ ID NO: 206 - protein, 266 aa, Rattus norvegicus
MHVNGKVALVTGAAQGIGKAFTEALLLHGAKVALVDWNLETGVKCKAALDEQFEPQKTLFIQCDVADQKQLRDTFRKVVDHFGRLDILVNNAGVNNEKNWEQTLQINLVSVISGTYLGLDYMSKQNGGEGGIIINISSIAGLMPVAQQPVYCASKHGIIGFTRSAAMAANLMKSGVRLNVICPGFVKTPILESIEKEENMGQYIEYTDQIKAMMKFYGILDPSAIANGLINLIEDDALNGAIMKITASKGIHFQDYDLFPSFSKAP

SEQ ID NO: 207 - protein, 58 aa, Mus musculus
NFSLPPGFGHRATDTALSVILVVMLLLIMLSLGCTMEFSKIKAHFWKPKGVIIAIVAQ

SEQ ID NO: 208 - protein, 49 aa, Mus musculus
FGHRATDTALSVILVVMLLLIMLSLGCTMEFSKIKAHFWKPKGVIIAIV

SEQ ID NO: 209 - protein, 93 aa, Rattus norvegicus
CEAKINDETYQSIMYIVLVVGYRIYDVVLSPPHEIELSAGEKLVLNCTARTELNVGLDFSWQFPSSKHQHKKIVNRDVKSLPGTVAKMFLSTL

SEQ ID NO: 210 - protein, 183 aa, Rattus norvegicus
VQEKTNLEVIILVGTAVIAMFFWLLLVILVRTVKRANEGELKTGYLSIVMDPDELPLDERCERLPYDASKWEFPRDRLKLGKPLGRGAFGQVIEADAFGIDKTATCKTVAVKMLKEGATHSEHRALMSELKILIHIGHHLNVVNLLGACTKPGGPLMVIVEFCKFGNLSTYLRGKRNEFVPYK

SEQ ID NO: 211 - protein, 538 aa, Mus musculus
MEGSANQLQPLSETQVVNSEGGCVWQVTDMNRLRRFLCFGSEGGTYYIKEQKLGLENAEALIRLIEDGRGCEVIQEIKSFSQEGRTAKQEPLLFALAVCSQCADINTKQAAFKAVPEVCRIPTHLFTFIQFKKDLKESMKCGMWGRALRKAVADWYNEKGGMAVALVVTKYKQRNGWSHKDLLRLSHLKPSSEGLAIVTKYITKGWKEVHEEYKEKALSVEAEKLLKYLEAVEKVKRTKDDLEVIHLIEEHQLVREHLLTNHLKSKEVWKALLQEMPLTALLRNLGKMTANSVLEPGNSEVSLICEKLSNEKLLKKARIHPFHVLIALETYRAGHGLRGKLKWIPDKDILQALDAAFYTTFKTVEPTGKRFLLAVDVSASMNQRALGSVLNASTVAAAMCMVVTRTEKESSVVAFACDMVPFPVTTDMTLQQVLTAMNKVPAGNTDCSLPMIWAQKTDTAADVFVVFTDNETFAGQVHPAVALREYRKKMDIPAKLIVCGMTSNGFTIADPDDRGMLDMCGFDTAALDVIRNFTLDVI

SEQ ID NO: 212 - protein, 142 aa, Rattus norvegicus
KHSLFDSCKMSRGGPFTEDKVEDVKALVKIVPVFLALIPYWTVYFQMQTTYVLQSLHLKIPEISSITTTHHTLPAAWLTMFDAVLILLLIPLKDKLVDPVLRRHGLLPSSLKRIAVGMFFVTCSAFAAGILESKRLDLVKEK

SEQ ID NO: 213 - protein, 152 aa, Rattus norvegicus
DSCKMSRGGPFTEDKVEDVKALVKIVPVFLALIPYWTVYFQMQTTYVLQSLHLKIPEISSITTTHHTLPAAWLTMFDAVLILLLIPLKDKLVDPVLRRHGLLPSSLKRIAVGMFFVTCSAFAAGILESKRLDLVKEKTINQTIGGVVYHAAD

SEQ ID NO: 214 - protein, 424 aa, Mus musculus
MARPALLGELLVLLLWTATVGQVAAATEVQPPVTNLSVSVENLCTIIWTWSPPEGASPNCTLRYFSHFDDQQDKKIAPETHRKEELPLDEKICLQVGSQCSANESEKPSPLVKKCISPPEGDPESAVTELKCIWHNLSYMKCSWLPGRNTSPDTHYTLYYWYSSLEKSRQCENIYREGQHIACSFKLTKVEPSFEHQNVQIMVKDNAGKIRPSCKIVSLTSYVKPDPPHIKHLLLKNGALLVQWKNPQNFRSRCLTYEVEVNNTQTDRHNILEVEEDKCQNSESDRNMEGTSCFQLPGVLADAVYTVRVRVKTNKLCFDDNKLWSDWSEAQSIGKEQNSTFYTTMLLTIPVFVAVAVIILLFYLKRLKIIIFPPIPDPGKIFKEMFGDQNDDTLHWKKYDIYEKQSKEETDSVVLIENLKKAAP

SEQ ID NO: 215 - protein, 257 aa, Bothrops jararaca
MVLIRVLANLLILQLSYAQKASELIIGGRPCDINEHRSLALVKYGNFQCSGTLINQEWVLSAAHCDGEKMKIHLGVHSKKVPNKDKQTRVAKEKFFCLSSKNYTKWDKDIMLIRLDSPVKNSAHIAPISLPSSPPIVGSVCRIMGWGTISTSKVILSDVPHCANINLLNYTVCRAAYPELPATSRTLCAGILQGGKDTCVGDSGGPLICNGQFQGIVSWGSDVCGYVLEPALYTKVSDYTEWINSIIAGNTTATCPP

SEQ ID NO: 216 - protein, 142 aa, Callithrix geoffroyi
MVHFTAEEKAAITSLWGKMNVEEAGGEALGRLLVVYPWTQRFFDNFGNLSSPSAILGNPKVKAHGKKVLTSFGDAIKNMDNLKTTFAKLSELHCDKLHVDPENFRLLGNVLVIILATHFGKEFTPEVQAASQKLVSAVAIAL

SEQ ID NO: 217 - protein, 49 aa, Schizosaccharomyces pombe
VVQLLSMKTSDTLFVDFVDYWTKSSSEIFKMLKEHLSGHIVKIGNSQYL

SEQ ID NO: 218 - protein, 55 aa, Schizosaccharomyces pombe
VVQLLSMKTSDTLFVDFVDYWTKSSSEIFKMLKEHLSGHIVKIGNSQYLQKVGIP

SEQ ID NO: 219 - protein, 49 aa, Schizosaccharomyces pombe; identical to SEQ ID NO: 217

SEQ ID NO: 220 - protein, 55 aa, Schizosaccharomyces pombe; identical to SEQ ID NO: 218

SEQ ID NO: 221 - protein, 433 aa, Schizosaccharomyces pombe
MATQNYKVADISLAAFGRKELEIAENEMPGLIAVREKYAKSQPLKGARIAGCLHMTIQTAVLIETLVALGAEVTWSSCNIYSTQDHAAAAIAATGVPVFAWKGETEEEYLWCIEQQLKSFPSGKPLNMILDDGGDLTALVHERHPELLVDIRGISEETTTGVHNLYKMFKENKLKVPAINVNDSVTKSKFDNLFGCKESLVDGIKRATDVMIAGKVAVVAGFGDVGKGCSTSLRSQGARVIVTEVDPINALQAAMDGFEVTTMEEAVKEGQIFVTTTGCRDIIRGEHFNEMKEDSIVCNIGHFDVEIDVAWLKANAKDVVNIKPQVDRYELKNGRHIILLADGRLVNLGCATGHPSFVMSCSFTNQVLAQIALWTDNTSYPLGVHMLPKKLDEEVARLHLGKLGVKLTTLTSVQSDYLGIPVDGPYKADHYRY

SEQ ID NO: 222 - protein, 94 aa, Schizosaccharomyces pombe
LFTLELWKLRVRGALSKFPTNCLRSVYSHTVSLMKYLTSAVISCWRIYLLIGILAAITGTVVWRIRVYAKKHVVKHGVSVCVSHCIAKLQKTKL

SEQ ID NO: 223 - protein, 131 aa, Schizosaccharomyces pombe
GALSKFPTNCLRSVYSHTVSLMKYLTSAVISCWRIYLLIGILAAITGTVVWRIRVYAKKHVVKHGVSVCVSHCIAKLQKTKLKSLTDFSVNPRVEVVQLRSDCFVSGVADDKGLFELVHLPLSIQLEIWEK

SEQ ID NO: 224 - protein, 284 aa, Schizosaccharomyces pombe
MLIAAMGPKIPVPAYGVGTALFKKEKGEINRTIVDSVKNALAAGFIHIDCAEVYGNEEEVGVALKEANVPRSKLFITSKVMHNVDNIPEALNESLRKLGTDYLDLYLLHSPIPFYEKKIPISEGWKAMETALGTGLVHSVGVSNFRIPDLEELLKTSTITPRVNQIEFHPQVYKAAKPLVEFCQSKGIIVEGYGPLSPLVRDAQGPVAEFTKSLESKYHVSDTQILLKWAYSKGVIPITTTSKIERMKECLNFDSFTLDKADIDELGTLGVQHHKRTFMKHMDE

SEQ ID NO: 225 - protein, 580 aa, Schizosaccharomyces pombe
MDKHFINDPEVLVLDGLKSLADMNKTLTVHEEGKFIYFHDYNKKNVSVISGGGAGHEPTHSSFVGKGMLTAAVSGSIFASPSSKQIYTGIKQVESEAGTLVICKNYTGDILHFGMALEKQRTAGKKAELIAVADDVSVGRKKSGKVGRRGLSGTVLVHKIAGAAAARGLPLEAVTTIAKAAIDNLVSIGASLAHVHVPGHEPIAKEDEMKHDEMELGMGIHNEPGCKRISPIPSIDDLIAQMLKQMLDQSDKDRAYVKIEGDDEVVLLMNNLGGLSMLEFSAISHKVKEALAKEYKINPVRIFAGPFTTSLNGLGFGITLLRTTDRVKVEGEEYSLVDLIDQPVEAIGWPLCQPSDLKSKNKIGNVSIEEGQKDVKSPVTVDKEKVRQAIVNSMENLIKAEPKITKFDTMAGDGDCGTTLKRGAEGVLKFVKSDKFSDDPIRIVRDIADVIEDNMDGTSGALYAIFFHGFAKGMKDTLEKSKDISSKTWAAGLKVALDTLFKYTPARPGDSTMCDALVPFVETFVKTNDLNAAVEEARKGADATADMQAKLGRAVYVGDDVKVPDAGALGVVAIVEGFTK

SEQ ID NO: 226 - protein, 424 aa, Schizosaccharomyces pombe
MLVLKIVLFLSLVIWFNLKKRTDKKRIIVLVLGDIARSPRMQYHAVSFAKLGWKVDLLGYQHPGSSVGLFESHENIRFYPIPSLPAYLQPKNRLQFLFLGPLKVLHQFLALNWALFVRKPASFLFIQNPPCIPVFFIAQCLHILRGTKFIIDWHNFGYSILALKLGKQHTFVKLLKIYEKYMARGAYAHLTVSKRMKDVLQTWGMNPCYVCYDRPPNHFTPIKNEQKKQMSIKKIPCEYNPSSTKLLITSTSWTPDEDIYILWEALNEYDKTLDTPKLLVLITGKGPMKEEFSQYIKKHPLHKVRFCMPWLSIEDYPQVMACADLGVCLHTSSSGLDLPMKVVDLFGCGVPVIALSYPTISELVHDGENGLIVNDSKALSKKMQYLLTHANELNSLKLGALKESEYRWDDEWNKVIPPIVQGSN

SEQ ID NO: 227 - protein, 227 aa, Schizosaccharomyces pombe [sequence omitted]

SEQ ID NO: 228 - protein, 55 aa, Schizosaccharomyces pombe
HLLKWTCVWPNQSSHVEVIDYNIECKKTVALSMDSITKTCILNYKLEWTYSGVLL

SEQ ID NO: 229 - protein, 71 aa, Schizosaccharomyces pombe
CVWPNQSSHVEVIDYNIECKKTVALSMDSITKTCILNYKLEWTYSGVLLHRPWKLFSLKPFTAAFVLLLAA

SEQ ID NO: 230 - protein, 312 aa, Schizosaccharomyces pombe
MEKHQYRDLQLIGQGSFGSVFRAQDVESSKIVALKVVDLDATKDQIETLTQEINFLIDLNSVHITKYYASFVDGFRLWITMEYCDGGSCLDLLKLSGTFSERVIAEVMRQVLEALVYLHGQGKMHRDIKAANILTMKDGLVKLADFGVSGQLESLRDKNDDFVGTPFWMAPEVVKQTGYNYKADIWSLGITAYELATGEPPYSGIHPMKVLLLIPKHSPPSLERSKFSRAFCDFVSNCLKKNPKDRATAEYLSKHKFIKKYCPNTSVKEVVASYAKWKESELLPEATPYNSTMGNSANTIDEVVWDFGTVRR

SEQ ID NO: 231 - protein, 401 aa, Schizosaccharomyces pombe
MSLTPDEKYELITRNLQEVLGAKMIREILNERDISLYWGSAPTGRPHCGYFVPMMKLADFLKAGVHVTVLLADVHAFLDNMKAPMELVQHRVRYYEIIVKSILKSLNIPIEKLRFVIGSSYQLKEDYTLDNFRLAASTTEHTARRAGAEVVKQVASPLLSSLIYPGMQALDEQYLGVDVQFGGVDQRKIFVMAEEVLPVLGYKKRGHLMNPMVPSLAGGKMSSSAAANAKIDILDDPKTVNKKIRSAFCEPGVVEENGCLAFLKYVSFPAMELRGETEFVIDRPEQFGGRMVFKTYEEVEKAYKDLTLSPQDLKLGLESSVNTLLAGVQEQLKQYPDLDSILKAAYPDPKDLKKAMKQKKQDKKNAKKAGTTNASIAAESGAAPATESQTAESFKKLNLDD

SEQ ID NO: 232 - protein, 334 aa, Schizosaccharomyces pombe
MTLSGKPAALLVGTLKHAHKEWEALGKYAELKTYSDGTREDFLAKCKTEFQNVKAICRTYNSKFYMGIFDKEIIDNLPPSVKFICHLGAGYETVDVAACTARGIQVSHVPKAVDDATADVGIFLMLGALRGFNQGIFELHKNNWNANCKPSHDPEGKTLGILGLGGIGKTMAKRARAFDMKIVYHNRTPLPEEEAEGAEFVSFDDLLAKSDVLSLNLPLNAHTRHIIGKPEFQKMKRGIVIVNTARGAVMDEAALVEALDEGIVYSAGLDVFEEEPKIHPGLLENEKVILLPHLGTNSLETQYKMECAVLMNVKNGIVNDSLPNLVPEQRGDIE

SEQ ID NO: 233 - protein, 1057 aa, Schizosaccharomyces pombe
MTSSVLIQGYEEDDVLKLLQELLDAETSQSCADVGKKIAQLFSNDNPLVTLKTTGFLDGLERAARNKKSGFHREAAMIGFATVIKNLGTPSEVVFLPYLPTILDSFSDRGEVVRQAAKMAAQALLDCLPAGAVETRLIPSLISYLDDSSIKWPSKVAALQLLGSLASSSPKAVADYMAALIPCIKERMHDTKPEISRAAITCMLNLCSVVENNDIIPHIPKLVDCMAHPETLEACIKDLSATTFVATVESVALAVLVPILKRALAQRSQSMLRLTVIITDNLCKLVPDPAEASDFLPELIPDVERIAQTAAMPEVRALASHALTTLNKAAAAQAAKAANNSEKQALDSACKELREAVLKNTSVPHELANSIIDYVCDALAALYKSNNFDKDKWTSQLGVLYLSPLVGEELASQISSKIYDDLHAFYKSLNSVDGISNLTIEEEELVNTDFSLAYGGRLLLSHTNLHLYRGHRYGVVGHNGCGKSTLLRAIGDYKVENFPSPDEVKTCFVAHSLQGEDTSMAILDFVAQDKALLTMNVTRQEAADALHSVGFTAEMQENPVASLSGGWKMKLELARAMLQKADILLLDEPTNHLDVANIAWLEAYLTSQKNITCLIVSHDSSFLDHVCTDIIHYEGVKNQAKKLGYYQGNLSAFVKVKPEAKSYYTLTATNEKFVFPPPGILTGVRSNTRLILKMTNASYTYPNAKKKSLDNVTVGLSLSSRVAILGPNGAGKSTLIKVLIGEVIPQEGKVFKHPNLRVGYVAQHAFHHLDQHLEKTPSQYIQWRYAGGQDREVSEKESRKLTEEDRAQLQRDITVNGERRRVEALIGRQKLKKSFQYEIKWFGKPHKYNTWVSREILLENGFQKFVQAFDDMESSREGLGFRELIPEDIRAHFEDVGLPGDIADYSPISSLSGGQKVKVVIAACLWNNPQLLVLDEPTNFLDRDALGGLAVAIRDWEGGVVMISHNEEFVSALCPEHWHVEAGKVTGKGKTAVDDGKFEDLSEKDLKKIEAKATKKKKLTRNEIKAKERRARERELAWLQSPKGTEKPKSFFSDDEE

SEQ ID NO: 234 - protein, 162 aa, Schizosaccharomyces pombe
MNAFVTVGSTQFDDLIRAVLKPEFQHCLVKHGINQLIVQYGKGKQAFGDPKSVAGLTILGFDYAPEIESYIHDASIVISHAGAGSILQTLRSGKRLLVVPNESLMDNHQVELATKLASMNYLVTCSTSNLVEGLEELYPKILTPFPKSDCSTFQKVMQDVAR

SEQ ID NO: 235 - protein, 67 aa, Schizosaccharomyces pombe
LTLWLMSLVIAVVTSSFIDLQHSGKNQKEQKSVDKHLIRNKLCEKYLFYSNFIWISFIVAQFVTLCT

SEQ ID NO: 236 - protein, 66 aa, Schizosaccharomyces pombe
TLWLMSLVIAVVTSSFIDLQHSGKNQKEQKSVDKHLIRNKLCEKYLFYSNFIWISFIVAQFVTLCT

SEQ ID NO: 237 - protein, 149 aa, Schizosaccharomyces pombe
MKAVIQRVLNASVSVDDKIVSAIQQGYCILLGVGSDDTPEDVTKLSNKILKLKLFDNAEQPWKSTIADIQGEILCVSQFTLHARVNKGAKPDFHRSMKGPEAIELYEQVVKTLGESLGSDKIKKGVFGAMMNVQLVNNGPVTILYDTKE

SEQ ID NO: 238 - protein, 215 aa, Schizosaccharomyces pombe
MKLGIFGLLLFTFFFQSQAVHFYFDGSKPKCFLKDMPKGMMVTGIVKAEQWNNEANKWVTSNNIKIRVQVDETFANNHLIYKNDLRSNEAVRFTTTNEGTHRICYLSTSDGAWFSSTKTRLHVDLASDDKYNLIASSEDEAKDLTDRVAALNTRLESILGEQMLQRSREMTFRDTSESANSRVVRWTIVQIVVLLVTCIWQLSHLQRFFVKEKLV

SEQ ID NO: 239 - protein, 287 aa, Schizosaccharomyces pombe
MLGIRKNIRISVNFLQRRTITVKQKLGKNRPLPGWDPNSEYFRPGPTMLNRLQEHLHDTILPDVLAASYRHDIDTALSTDEHTQKDRLPRWIGDNPYYKNRPPQKMRGNKPLLPVKESVNPKNLPSISKVVVSTMHKEALVDKTQLLSTMMAFRSITGLQPEIVYARKDVSPWKLRSGVPVGVKVTLTGESMYTFLSILSELVLPQLHDFKGLSPTSGDQTGNISFGLPSEVMPLFPQIEAVYEMYPHSLPGFNVNITTNSKDTRLARFFVSSLIPFTDGNKEGYVG

SEQ ID NO: 240 - protein, 247 aa, Schizosaccharomyces pombe
MAETAEKVILLTGSSKGIGLATAEALQKKAKVIAVSRSLTPELETLLIQNPDSFVHVKGDVTEVGKASIETAIKKFGKLDSVILNAGVLEPIAKIADADINEWRKLFDINFFSVVETVKYAIPHLRKTKGTIVIVSSGAAVRVFPAWAAYCCSKAAINMLVMNLGSEEPDIMSVAVRPGVVDTPMQVSIRNDSNKEAMGGDTHNFFKELKTSGQLVAPQDIAKALSFLALNNNPKLTGQFVEWKSFV

SEQ ID NO: 241 - protein, 670 aa, Caenorhabditis elegans
MLSKLFVFLLICYATADEVDKKEAKHGFQLFHWNWDHIHKVYVITTWLLVASLAKILFNLMKPLSKWLPDSSLLIIVGLGLGYFLNQTTLSGVHLDSHAFFLYLLPPIIFDAGYFMPNRALFKNFDSVLVFSVLGTLWNTFAIGGSLLIMSKYQLFTMPFTTFEILVFSALISAVDPVAVIAIFEEIHVNEFLFINVFGEALFNDGVTVVLYQMFKSFALIGSENLSPWDYATGGLSFFVVALGGAAIGIIFAIATSLATKYTQGIKILAPVFIFLLPYMAYLTAEMVSLSSIIAIAVCGMLMKQYIKGNITEAATNSVKYFTKMLAQCSETVIFMFLGLSTLTSEHHVDFIFIGATLVFCLIYRAIGIIVQCFILNKFRAKKFEVVDQFILSYGGLRGAIAYGLVVSIPASIQAKPMFITTTICVIYFTVFLQGITIRPLVNCLNVKKKEHREATMVESVYNKYLDYMMSGVEDIAGQRGHYSFIENFERFNAKVIKPVLMRHEKRQSFDATSIIRAYEKITLEDAIKLTKVKSTLQNKRLEKVKSEVRVAPEQTTVTPKDVQLARFMQSGENIDQLYTLFSDLLDKKLNELKVQADKVDKANDDDIQDDYMAEMGSHSNLGFMHHSADQLDSDSVFQRRGRRLSTGDLKGHCGTSRKPKHSMFELRHV

SEQ ID NO: 242 - protein, 28 aa, Caenorhabditis elegans
DHIHKVYVITTWLLVASLAKILFNLMKP

SEQ ID NO: 243 - protein, 23 aa, Caenorhabditis elegans
HKVYVITTWLLVASLAKILFNLM

SEQ ID NO: 244 - protein, 156 aa, Caenorhabditis elegans
QAMPDILKRLLKAKPEGDKVLFSKTAIKKYQTYVRTYLHAMIVFLNEVQTTEVLIATIKAMTRLVDLYAHFSRMSKLLIKAVVRIWSRKTLECRLPAFVCMNLLVKNYPQHFVPLYKTAYVAFVANSKIVTNETWPLLQFMHRTFAELTILNPEQA

SEQ ID NO: 245 - protein, 30 aa, Caenorhabditis elegans
TIKAMTRLVDLYAHFSRMSKLLIKAVVRIW

SEQ ID NO: 246 - protein, 527 aa, Caenorhabditis elegans
MGAIIVLVVLFATIAGYFKWIHTYWRRRGISGPEGLPFIGNYYDLADVNKPRGYLIHKWTQKFGKVFGYYEGAVPVLVVSDMDMLQELFLKKFDNFYARKSTNHIHGNLECSKSEPRINLFTSRGARWKRLRALASPGFSVKALKQVHDVMEDSAINMVDLMAKHEDGKPFNIHAYFQEFTYDVISRLAMGQPNSELFNNSGVEIVKSIFMRTHRVLPWYFTVLFPQFEHLVKRMFYNHAAVQGGDIEKLLLICKKTVESRIQEREENAKLGFENAENDFIDMFLNYYSEQVEDIEFGSTVEKKVTAEDVIGACFVFLLAGFDTTANSLAYASYLLAKHPEKMKLAQEEVDTVVGSENVSYDDMTKLKYLDAVVRESLRLYPVAWFACSRECVKPTTLGDIYIDKGVKIEADVMSLHRSKEIWGENADDFVPERWLEPSSRHTMSWIPFGAGPRQCVGMRLGLSEAKTALAHLLRRYDLVAGVETEVRLTLRFFFIFKSSQIQKELNILGCTTTSPEAVTLYLKPRI

SEQ ID NO: 247 - protein, 510 aa, Caenorhabditis elegans
MGAIIVLVVLFATIAGYFKWIHTYWRRRGISGPEGLPFIGNYYDLADVNKPRGYLIHKWTQKFGKVFGYYEGAVPVLVVSDMDMLQELFLKKFDNFYARKSTNHIHGNLECSKSEPRINLFTSRGARWKRLRALASPGFSVKALKQVHDVMEDSAINMVDLMAKHEDGKPFNIHAYFQEFTYDVISRLAMGQPNSELFNNSGVEIVKSIFMRTHRVLPWYFTVLFPQFEHLVKRMFYNHAAVQGGDIEKLLLICKKTVESRIQEREENAKLGFENAENDFIDMFLNYYSEQVEDIEFGSTVEKKVTAEDVIGACFVFLLAGFDTTANSLAYASYLLAKHPEKMKLAQEEVDTVVGSENVSYDDMTKLKYLDAVVRESLRLYPVAWFACSRECVKPTTLGDIYIDKGVKIEADVMSLHRSKEIWGENADDFVPERWLEPSSRHTMSWIPFGAGPRQCVGMRLGLSEAKTALAHLLRRYDLVAGVETEKELNILGCTTTSPEAVTLYLKPRI

SEQ ID NO: 248 - protein, 62 aa, Caenorhabditis elegans
VSVDNMEMDKRLKELIEHVKSTLLISLSQLKLNIFEFAAFKSFFVWKLVFHKTSVAMKTIGQ

SEQ ID NO: 249 - protein, 103 aa, Caenorhabditis elegans
VSVDNMEMDKRLKELIEHVKSTLLISLSQLKLNIFEFAAFKSFFVWKLVFHKTSVAMKTIGQEHYECVSSALKSYYQTYTSMDSTEIAVRIGEITLLLSLVFV

SEQ ID NO: 250 - protein, 277 aa, Caenorhabditis elegans
MDTTCRCLLTPTIQPVLLKMLYRLVAAILLLGAVQATINCAAIPTSLWCSNKDLEAKCGFASFCDKHRAATHNQKINITVLIEALCPDCQNFLTKQLYPIVFKNFANYVNIELVPFGNAKVLEDGTIKCQHGEEECSINKFEGCFIDSMQDQSPLPTLSCIEESLQKKVEFADAVQQCFEKLQIGGDIQRLTQSCLVSKLGADLQNKAAAATANVWPEQHKFVPWVIINGVSLTSFQGFQNQLPTLLCEWYSGDKAIPYCEAALKLKYKKASIRSFF

SEQ ID NO: 251 - protein, 93 aa, Bos taurus
SLAHVAILCTRFSYGEELQSFVGAFIVGTYNVVVVIVLTKLLVAMLHKSFQLIANHEDKEWKFARAKLWLSYFDDKCTLPPPFNIIPSPKTIC

SEQ ID NO: 252 - protein, 73 aa, Bos taurus
VGTYNVVVVIVLTKLLVAMLHKSFQLIANHEDKEWKFARAKLWLSYFDDKCTLPPPFNIIPSPKTICYMISSL

SEQ ID NO: 253 - protein, 960 aa, Bos taurus
MTMAGGRKGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGSVLTEHSHHGLAKASVVTVRESPATPVAFPAAAAPAGLDHARLQAPGAEGLGPKAGGADCAKRKGWARFKDACGQAEDWSKVSKAESMETLPERTKAAGEATLKKTDSCDSGITKSDLRLDNVGEARSPQDRSPILAEVKHSFYPIPEQTLQAAVLEVKHELKEDIKALSTKMTSIEKQLSEILRILTSRRSSQSPQELFEISRPQSPESERDIFGAS

SEQ ID NO: 254 - protein, 388 aa, Ipomoea nil
MVTVEEVRKAQRAEGPATILAIGTATPANCVDQSTYPDYYFRITNSDHMTDLKQKFQRMCDKSMITKRYMHLTEEILKENPSFCEYMAPSLDARQDIVVVEVPKLGKEAAQSAIKEWGQPKSKITHVIFCTTSGVDMPGADYQLTKLLGLRPSVKRLMMYQQGCFAGGTVLRVAKDLAENNKAARVLVVCSEITVVTFRGPNETHLDSLVGQALFGDGAAAIIVGSDPTPAEKPLFQLVSAAQTLAPDSCGAIDGHLREVGLTFHLLKDVPSIVSNNIEKCLSEAFNPLGISDWNSIFWIAHPGGPAILDQVEDKLGLKPEKLRATRHVLSEYGNMSSACVLFILDEMRKASSNDGLGTTGEGLEWGVLFGFGPGLTIETVVLHSVPA

SEQ ID NO: 255 - protein, 389 aa, Ipomoea nil
MVTVEEVRKAQRAQGPATIMAIGTSTPQNCVDQSTYPDYYFRITNSEHLVELKEKFKRMCEKSMIKKRYMYLTEEILKENPNICAYMAPSLDARQDIVVVEVPKLGKEAAQKAIKEWGQPKSKITHLVFCTTSGVDMPGADYQLTKLLGLQPSVKRFMMYQQGCFAGGTVIRLAKDLAENNKGARVLVVCSEITAVTFRGPSDAHLDSLVGQALFGDGAAALIIGSDPDPDLERPLFQLVSAAQTILPDSGGAIDGHLREVGLTFHLLKDVPGLISKHIEKSLNEAFQPLGIHDWNSLFWIAHPGGPAILDQVEEKLELKPEKLRATRHVLSEYGNMSSACVLFILDEMRKASSKEGLNTTGEGLEWGVLFGFGPGLTVETVVLHSVSA

SEQ ID NO: 256 - protein, 389 aa, Ipomoea purpurea
MVTVEEVRKAQRAQGPATIMAIGTSTPQNCVDQSTYPDYYFRITNSEHLVELKEKFKRMCEKSMIKKRYMYLTEEILTENPNICAYMAPSLDARQDIVVVEVPKLGKEAAQKAIKEWGQPKSKITHLVFCTTSGVDMPGADYQLTKLLGLQPSVKRFMMYQQGCFAGGTVIRLAKDLAENNKGARVLVVCSEITAVTFRGPSDAHLDSLVGQALFGDGAAALIIGSDPDPDLERPLFQLVSAAQTILPDSGGAIDGHLREVGLTFHLLKDVPGLISKHIEKSLNEAFQPLGIRDWNSLFWIAHPGGPAILDQVEEKLELKPEKLRATRHVLSEYGNMSSACVLFILDEMRKASSKEGLNTTGEGLEWGVLFGFGPGLTVETVVLHSVSA

SEQ ID NO: 257 - protein, 361 aa, Arabidopsis thaliana
MKALILVGGFGTRLRPLTLSFPKPLVDFANKPMILHQIEALKAVGVDEVVLAINYQPEVMLNFLKDFETKLEIKITCSQETEPLGTAGPLALARDKLLDGSGEPFFVLNSDVISEYPLKEMLEFHKSHGGEASIMVTKVDEPSKYGVVVMEESTGRVEKFVEKPKLYVGNKINAGIYLLNPSVLDKIELRPTSIEKETFPKIAAAQGLYAMVLPGFWMDIGQPRDYITGLRLYLDSLRKKSPAKLTSGPHIVGNVLVDETATIGEGCLIGPDVAIGPGCIVESGVRLSRCTVMRGVRIKKHACISSSIIGWHSTVGQWARIENMTILGEDVHVSDEIYSNGGVVLPHKEIKSNILKPEIVM

SEQ ID NO: 258 - protein, 394 aa, Raphanus sativus
MVGTTSSLDEIRKAQRADGPAGILAIGTANPANHVLQAEYPDYYFRITNSEHMTDLKEKFKRMCDKSTIRKRHMHLTEEFLKENPNMCAYMAPSLDARQDIVVVEVPKLGKEAAVKAIKEWGQPKSKITHVVFCTTSGVDMPGADYQLTKLLGLRPSVKRLMMYQQGCFAGGTVLRLAKDLAENNRGARVLVVCSEITAVTFRGPSDTHLDSLVGQALFSDGAAALIVGSDPDVSAGEKPIFEMVSAAQTILPDSDGAIDGHLREVGITFHLLKDVPGLISKNIEKSLDEAFKPLGISDWNSLFWIAHPGGPAILDDVEKKLGLKAEKMRATRHVLSEYGNMSSACVLFILDEMRRKSLDDGVATTGEGLEWGVLFGFGPGLTVETVVLHSVPV

SEQ ID NO: 259 - protein, 162 aa, Arabidopsis thaliana
MAPITVGDVVPDGTISFFDENDQLQTVSVHSIAAGKKVILFGVPGAFTPTCSMSHVPGFIGKAEELKSKGIDEIICFSVNDPFVMKAWGKTYQENKHVKFVADGSGEYTHLLGLELDLKDKGLGIRSRRFALLLDNLKVTVANVENGGEFTVSSAEDILKAL

SEQ ID NO: 260 - protein, 59 aa, Arabidopsis thaliana
VGIMGLHGMGGVGKTTLFKKIHNKFAETGGTFDIVIWIVVSQGAKLSKLQEDIAEKLHL

SEQ ID NO: 261 - protein, 593 aa, Arabidopsis thaliana
MGIIDGSLLRRLICLCLWCLLGGGVTVVTAEDEKKVVHKQLNQTPTWAVAAVCTFFIVVSVLLEKLLHKVGKVLWDRHKTALLDALEKIKAELMVLGFISLLLTFGQTYILDICIPSHVARTMLPCPAPNLKKEDDDNGESHRRLLSFEHRFLSGGEASPTKCTKEGYVELISAEALHQLHILIFFLAIFHVLYSFLTMMLGRLKIRGWKHWENETSSHNYEFSTDTSRFRLTHETSFVRAHTSFWTRIPFFFYVGCFFRQFFRSVGRTDYLTLRNGFIAVHLAPGSQFNFQKYIKRSLEDDFKVVVGVSPVLWGSFVLFLLLNIDGFKMMFIGTAIPVIIILAVGTKLQAIMTRMALGITDRHAVVQGMPLVQGNDEYFWFGRPHLILHLMHFALFQNAFQITYFFWIWYSFGSDSCYHPNFKIALVKVAIALGVLCLCSYITLPLYALVTQMGSRMKKSVFDEQTSKALKKWRMAVKKKKGVKATTKRLGGDGSASPTASTVRSTSSVRSLQRYKTTPHSMRYEGLDPETSDLDTDNEALTPPKSPPSFELVVKVEPNKTNTGETSRDTETDSKEFSFVKPAPSNESSQDR

SEQ ID NO: 262 - protein, 172 aa, Arabidopsis thaliana
CLLGGGVTVVTAEDEKKVVHKQLNQTPTWAVAAVCTFFIVVSVLLEKLLHKVGKVLWDRHKTALLDALEKIKAELMVLGFISLLLTFGQTYILDICIPSHVARTMLPCPAPNLKKEDDDNGESHRRLLSFEHRFLSGGEASPTKCTKEGYVELISAEALHQLHILIFFLAIF

SEQ ID NO: 263 - protein, 81 aa, Arabidopsis thaliana
VCTFFIVVSVLLEKLLHKVGKVLWDRHKTALLDALEKIKAELMVLGFISLLLTFGQTYILDICIPSHVARTMLPCPAPNLK

SEQ ID NO: 264 - protein, 90 aa, Arabidopsis thaliana
EVSLDLYNHGANPSMVVRSAVHVLPREIFGKSTFELGVTMMKYMPVWLADKTILFLARIILGNTDKYGLKRPKIGPLELKNKEGKTPVLD

SEQ ID NO: 265 - protein, 73 aa, Arabidopsis thaliana
VSLDLYNHGANPSMVVRSAVHVLPREIFGKSTFELGVTMMKYMPVWLADKTILFLARIILGNTDKYGLKRPKI

SEQ ID NO: 266 - protein, 485 aa, Arabidopsis thaliana
MALLVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQQNGTLLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKAGIIVLAEGRLMNLGCATGHPSFVMSCSFTNQVIAQLELWNEKASGKYEKKVYVLPKHLDEKVALLHLGKLGARLTKLSKDQSDYVSIPIEGPYKPPHYRY

SEQ ID NO: 267 - protein, 176 aa, Arabidopsis thaliana
ALQALMEGLQVLTLEDVVSEADIFVTTTGNKDIIMVDHMRKMKNNAIVCNIGHFDNEIDMLGLETYPGVKRITIKPQTDRWVFPETKAGIIVLAEGRLMNLGCATGHPSFVMSCSFTNQVIAQLELWNEKASGKYEKKVYVLPKHLDEKVALLHLGKLGARLTKLSKDQSDYVSIP

SEQ ID NO: 268 - protein, 82 aa, Arabidopsis thaliana
ANIALLAYSKMGDFTSIELLLSELRIKHVKLDLVTVGIVFDLSEARFDGTGVFMTWKKIGFLDKPVEMKTDPLVHAAFGKGQ

SEQ ID NO: 269 - protein, 73 aa, Arabidopsis thaliana
IALLAYSKMGDFTSIELLLSELRIKHVKLDLVTVGIVFDLSEARFDGTGVFMTWKKIGFLDKPVEMKTDPLVH

SEQ ID NO: 270 - protein, 719 aa, Arabidopsis thaliana
MALTKLRFVNQFSQWLCVRKGYIHSLPENLAALQKAIEVLKTKHDDVKRRVDKEEFLGRRHRLSQVQVEIERLCFCGFCSKSFGKSYHYGKMVSVMLKEVENLSSRGVFDVVTEENLVAQVEEMPIQSTVVGQETMLERVWNTLMKDGFKIMGLYGMGGVGKTTLLTQINKKFSETDGGFDIVMWVVVSKTSEIYRIQEDIAKRLGLTGEEWDKKNENKRAVDIHNVLRRHKFVLLLDDIWEKVNLELVGVPYPSRENGSIVAFTTRSRDVCGRMGVDDPMQVSCLEPEDAWDLFQNKVGENTLKSHPDIPELAKQVAEKCRGLPLALNVIGETMACKSTVQEWRHAIDEEWKKTEVKMHDVVREMALWISSDLGKHKDQCIVRAGVGLHAVPEVKNWRAVRRMSLMKNELEKILGCPTCPQLTTLLLQKNHKLVNISGEFFRFMPNLVVLDLSWNSSLTGLPKKISEVETTNTSEFGVHEEFGEYAGVSKLLSLKTLRLQKSKKALDVNSAKELQLLEHIEVLTIDIFSKVEEESFKILTFPSMCNIRRIGIWKCGMKEIKVEMRTSSCFSSLSKVVIGQCDGLKELTWLLFAPNLTYLDARFAEQLEDIISEEKAASVTDENASIIIPFQKLECLSLSDLPKLKSIYWSPLSFPRLSELAVQEHCPKLKKLPLNSKSGTAGVELVVKYGENKWLEGVEWEDKATELRFLATCKSLYR

SEQ ID NO: 271 - protein, 475 aa, Arabidopsis thaliana
MEMESSLPHVMLVSFPGQGHISPLLRLGKIIASKGLIVTFVTTEEPLGKKMRQANNIQDGVLKPVGLGFLRFEFFEDGFVYKEDFDLLQKSLEVSGKREIKNLVKKYEKQPVRCLINNAFVPWVCDIAEELQIPSAVLWVQSCACLAAYYYYHHQLVKFPTETEPEITVDVPFKPLTLKHDEIPSFLHPSSPLSSIGGTILEQIKRLHKPFSVLIETFQELEKDTIDHMSQLCPQVNFNPIGPLFTMAKTIRSDIKGDISKPDSDCIEWLDSREPSSVVYISFGTLAFLKQNQIDEIAHGILNSGLSCLWVLRPPLEGLAIEPHVLPLELEEKGKIVEWCQQEKVLAHPAVACFLSHCGWNSTMEALTSGVPVICFPQWGDQVTNAVYMIDVFKTGLRLSRGASDERIVPREEVAERLLEATVGEKAVELRENARRWKEEAESAVAYGGTSERNFQEFVDKLVDVKTMTNINNVV

SEQ ID NO: 272 - protein, 190 aa, Arabidopsis thaliana
MEHEGKNNMNGMEMEKGKRELGSRKGVELTMRVLALILTMAAATVLGVAKQTKVVSIKLIPTLPPLDITTTAKASYLSAFVYNISVNAIACGYTAISIAILMISRGRRSKKLLMVVLLGDLVMVALLFSGTGAASAIGLMGLHGNKHVMWKKVCGVFGKFCHRAAPSLPLTLLAAVVFMFLVVLDAIKLP

SEQ ID NO: 273 - protein, 140 aa, Arabidopsis thaliana
AKQTKVVSIKLIPTLPPLDITTTAKASYLSAFVYNISVNAIACGYTAISIAILMISRGRRSKKLLMVVLLGDLVMVALLFSGTGAASAIGLMGLHGNKHVMWKKVCGVFGKFCHRAAPSLPLTLLAAVVFMFLVVLDAIK

SEQ ID NO: 274 - protein, 113 aa, Arabidopsis thaliana
KQTKVVSIKLIPTLPPLDITTTAKASYLSAFVYNISVNAIACGYTAISIAILMISRGRRSKKLLMVVLLGDLVMVALLFSGTGAASAIGLMGLHGNKHVMWKKVCGVFGKFCH

SEQ ID NO: 275 - protein, 370 aa, Clarkia breweri
MGSTGNAETQLTPTHVSDEEANLFAMQLASASVLPMVLKAAIELDVLEIMAKSIPHGSGAYISPAEIAAQLPTTNPDAPVMLDRVLRLLASYSVVTCSLRELPDGKVERLYGLAPVCKFLTKNEDGVSLAPLCLMNQDKVLMESWYYLKDAILDGGIPFNKAYGMTAFEYHGTDPRFNKVFNRGMSDHSTITMKKIFEMYTGFEALNTIVDVGGGTGAVLSMIVAKYPSIKGINFDLPHVIEDAPIYPGVEHVGGDMFVSVPKGDAIFMKWICHDWSDEHCLKFLKNCYAALPEHGKVIVAECILPLSPDPSLATKGVIHIDAIMLAHNPGGKERTEKEFEALAIGAGFKGFKVACCAFNTYVMEFLKTA

SEQ ID NO: 276 - protein, 490 aa, Helianthus tuberosus
MDFLIIVSTLLLSYILIWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSGKEFREVITNIMVDSAKTNLVDVFPVLKKIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 277 - protein, 134 aa, Helianthus tuberosus
FEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIG

SEQ ID NO: 278 - protein, 547 aa, Nicotiana tabacum
MPMETTTETKQSGDLIFRSKLPDIYIPKHLPLHSYCFENISEFSSRPCLINGANDQIYTYAEVELTCRKVAVGLNKLGIQQKDTIMILLPNSPEFVFAFMGASYLGAISTMANPLFTPAEVVKQAKASSAKIIITQSCFVGKVKDYASENDVKVICIDSAPEGCLHFSELTQSDEHEIPEVKIQPDDVVALPYSSGTTGLPKGVMLTHKGLVTSVAQQVDGENANLYMHSEDVLMCVLPLFHIYSLNSILLCGLRVGAAILIMQKFDIAPFLELIQKYKVSIGPFVPPIVLAIAKSPIVDSYDLSSVRTVMSGAAPLGKELEDAVRTKFPNAKLGQGYGMTEAGPVLAMCLAFAKEPFDIKSGACGTVVRNAEMKIVDPDTGCSLPRNQPGEICIRGDQIMKGYLNDPEATTRTIDKEGWLHTGDIGFIDEDDELFIVDRLKELIKYKGFQVAPAEIEALLLNHPNISDAAVVPMKDEQAGEVPVAFVVRSNGSAITEDEVKDFISKQVIFYKRVKRVFFVETVPKSPSGKILRKDLRARLAAGVPN

SEQ ID NO: 279 - protein, 542 aa, Nicotiana tabacum
MEKDTKQVDIIFRSKLPDIYIPNHLPLHSYCFENISEFSSRPCLINGANKQIYTYADVELNSRKVAAGLHKQGIQPKDTIMILLPNSPEFVFAFIGASYLGAISTMANPLFTPAEVVKQAKASSAKIIVTQACHVNKVKDYAFENDVKIICIDSAPEGCLHFSVLTQANEHDIPEVEIQPDDVVALPYSSGTTGLPKGVMLTHKGLVTSVAQQVDGENPNLYIHSEDVMLCVLPLFHIYSLNSVLLCGLRVGAAILIMQKFDIVSFLELIQRYKVTIGPFVPPIVLAIAKSPMVDDYDLSSVRTVMSGAAPLGKELEDTVRAKFPNAKLGQGYGMTEAGPVLAMCLAFAKEPFEIKSGACGTVVRNAEMKIVDPKTGNSLPRNQSGEICIRGDQIMKGYLNDPEATARTIDKEGWLYTGDIGYIDDDDELFIVDRLKELIKYKGFQVAPAELEALLLNHPNISDAAVVPMKDEQAGEVPVAFVVRSNGSTITEDEVKDFISKQVIFYKRIKRVFFVDAIPKSPSGKILRKDLRAKLAAGLPN

SEQ ID NO: 280 - protein, 223 aa, Helicobacter pylori
MPARQSFTDLKNLVLCDIGNTRIHFAQNYQLFSSAKEDLKRLGIQKEIFYISVNEENEKALLNCYPNAKNIAGFFHLETDYVGLGIDRQMACLAVNNGVVVDAGSAITIDLIKEGKHLGGCILPGLAQYIHAYKKSAKILEQPFKALDSLEVLPKSTRDAVNYGMVLSVIACIQHLAKNQKIYLCGGDAKYLSAFLPHSVCKERLVFDGMEIALKKAGILECK

SEQ ID NO: 281 - protein, 84 aa, Helicobacter pylori
MRIDKFLQSVGLVKRRVLATDMCNVGAVWLNGSCAKASKEVKAGDTISLHYLKGIEEYTILQIPALKNVPRKDTHLYIAPKTKE

SEQ ID NO: 282 - protein, 251 aa, Archaeoglobus fulgidus
MLTFVGLGLWDVKDISVKGLEAVREADEVYVEYYTSKLLSSIEEMEEFFGKRVVELERSDLEENSFRLIERAKSKSVVLLVPGDPMVATTHSAIKLEAERKGVKTRIIHGASISTAVCGLTGLHNYRFGKSATVSWHRSQTPVNVIKANRSIDAHTLLFLDLHPEPMTIGHAVENLIAEDAQMKDLYAVGIARAGSGEEVVKCDRLENLKKIDFGKPLHVMVVLAKTLHFMEFECLREFADAPAELERLVA

SEQ ID NO: 283 - protein, 175 aa, Archaeoglobus fulgidus
MAKALEQPFDVANIPGPKMATLLEKGKPVANMIKKAKRPLLIVGPDMTDEMFERVKKFVEKDITVVATGSAITRFIDAGLGEKVNYAVLHELTQFLLDPDWKGFDGQGNYDLVLMLGSIYYHGSQMLAAIKNFAPHIRALAIDRYYHPNADMSFGNLWKKEEDYLKLLDEILAEL

SEQ ID NO: 284 - protein, 339 aa, Methanosarcina barkeri
MAEYTPKERLYRALRKQQVDRMPAVCFTQTATVEQMEACGAYWPEAHSDAEKMATLAEAAHTVVGFEAVRVPFDITAEAEFFGCGIKAGDLKQQPSVIKPSVKNLEDLEKLKNYNLKEGRIAVVLEAVKILSEKYGKELPIIGSMIGPFSLAQHINGDAWFGNLFTGEEVVPALLDFCSDFNVAYAKAMVENGADTIAIIDPTASYELIGGEFYEKYALPYQKKIVDAMKELDVATVLHICGNTTNGLGIMDKTGVNGISVDQKVDIKTATGSVKNAIIVGNLDPVAVLWNGTPEEIAEASKKALDAGVGLLTVGCGTVSMTPTVNLQKMIECAKSHTY

SEQ ID NO: 285 - protein, 269 aa, Bacillus cereus
MKLNRAIGVIDSGVGGLTVAKELIRQLPKERIIYLGDTARCPYGPRSREEVRQFTWEMTEHLLDLNIKMLVIACNTATAVVLEEMQKQLPIPVVGVIHPGSRTALKMTNTYHVGIIGTIGTVKSGAYEEALKSINNRVMVESLACPPFVELVESGNFESEMAYEVVRETLQPLKNTDIDTLILGCTHYPILGPVIKQVMGDKVQLISSGDETAREVSTILYHSKMLNEGEEQSDHLFLTTGKIGLFKEIASKWFGQPIENVKHIYLEKE

SEQ ID NO: 286 - protein, 141 aa, Bacillus subtilis
MKDEQMLTEWPSHLPWLNQSQNDFTFPSDTYLLLYFWSMSCPNCHQLTDKVLQDIKDMNVKVIGVHVPYIEEEKSMEVVLTYALDRGLAIPIVLDQNYEIVTTCHVQGIPSFCLLSQYGQIITKTMGDVGWDKMLKKIAGL

SEQ ID NO: 287 - protein, 1052 aa, Bacillus subtilis
MNHVINFVLKNKFAVWLMTIIVTAAGLYAGMNMKQESIPDVNMPYLTISTTYPGATPSQVADEVTKPVEQAVQNLDGVSVVTSTSYENASSVMIEYDYEKDMDKAKTEAAEALENVNLPDDAKDPEISRYSLNSFPILTLSVSSDKDNLQELTKQVEDSLVSKLEGIEGVASVQVSGQQVEEVEFSFKEDKLKEYGLDEDTVKQVIQGSDVTTPLGLYTFGNEEKSVVVSGDIETIKDLKNMRIPTASASSAGSSAASQAGAQSAQAAQSAQAAAQVQQSASTAVPTVKLSDIATIKDVKKAESVSRTNGKDSIGINIVKANDANTVEVADDVKAELKKFKEDHKGFNYSATLDMAEPITQSVDTMLSKAIFGAIFAIVIILLFLRDIKSTLISVVSIPLSLLIALLVLQQLDITLNIMTLGAMTVAIGRVVDDSIVVIENIYRRMRLKDEPLRGKALVREATKEMFKPIMSSTIVTIAVFLPLALVGGQIGELFIPFALTIVFALAASLVISITLVPMLAHSLFKKSLTGAPIKAKEHKPGRLANIYKKVLNWALSHKWITSIIAVLMLLGSLFLVPLIGASYLPSEEEKTMQLTYSPEPGETKKEAENEAEKAEKILLDRKHVDTVQYSLGSGSPLAGGDSNGALFYIKYESDTPDFDKEKDNVLKEIQKQSDRGEWKSQDFSSSGNNNELTYYVYGDSENDIKDTVKDIEKIMKDEKDLKNVNSGLSSTYDEYTFVADQEKLSKLGLTASQISQALMSQTSQEPLTTVKKDGKELDVNIKTEKDEYKSVKDLENKKITSATGQEVKIGDVAKVKEGSTSDTVSKRDGKVYADVTGEVTSDNVTAVSAAIQKKIDKLDHPDNVSIDTGGVSADIADSFTKLGLAMLAAIAIVYLVLVITFGGALAPFAILFSLPFTVIGALVGLYVSGETISLNAMIGMLMLIGIVVTNAIVLIDRVIHKEAEGLSTREALLEAGSTRLRPILMTAIATIGALIPLALGFEGGSQVISKGLGVTVIGGLISSTLLTLLIVPIVYEVLAKFRKKKPGTEEE

SEQ ID NO: 288 - protein, 36 aa, Bacillus subtilis
AFLPVKGECLSVWNDDIPLTKTLYHDHCYIVPRKSG

SEQ ID NO: 289 - protein, 32 aa, Bacillus subtilis
LPVKGECLSVWNDDIPLTKTLYHDHCYIVPRK

SEQ ID NO: 290 - protein, 82 aa, Bacillus subtilis
EEYRAAGVPLLPVVKGNHVTKIKMMQYIAVLVPVTLLFPFSLGTGHISPFYFLAALVLGGIWIKKSIKGFKTDDDVKWAKDM

SEQ ID NO: 291 - protein, 48 aa, Bacillus subtilis
HVTKIKMMQYIAVLVPVTLLFPFSLGTGHISPFYFLAALVLGGIWIKK

SEQ ID NO: 292 - protein, 506 aa, Bacillus subtilis
MLERCKLKILKGACGRVKLYIILVVIPAIVISFFVYEKEKDTIAAEHKQEASVLLNLHRNKINYLIGETMARMTSLSIAIDRPVDIKKMQSILEKTFDSEPRFSGLYFLNAKGDVTASTTELKTKVNLADRSFFIKAKETKKTVISDSYSSRITGQPIFTICVPVLDSKRNVTDYLVAAIQIDYLKNLINLLSPDVYIEVVNQDGKMIFASGQASHAEDQKPVSGYLDDISWNMKVYPNPVTIEELSKSLVLPLSCIIVLLNILFILVLYYLLKRQTQLERSENEAQKLELIGTLAASTAHEIRNPLTGISGFIQLLQKKYKGEEDQLYFSIIEQEIKRINQIVSEFLVLGKPTAEKWELNSLQDIIGEIMPIIYSEGNLYNVEVELQYLTEQPLLVKCTKDHIKQVILNVAKNGLESMPEGGKLTISLGALDKKAIIKVVDNGEGISQEMLDHIFLPFVTSKEKGTGLGLVVCKRIVLMYGGSIHIESEVRRGTEVTITLPVSAS

SEQ ID NO: 293 - protein, 219 aa, Bacillus subtilis
MKKEKAIVVFSGGQDSTTCLLWALKEFEEVETVTFHYNQRHSQEVEVAKSIAEKLGVKNHLLDMSLLNQLAPNALTRNDIEIEVKDGELPSTFVPGRNLVFLSFASILAYQIGARHIITGVCETDFSGYPDCRDEFVKSCNVTVNLAMEKPFVIHTPLMWLNKAETWKLADELGALDFVKNNTLTCYNGIIADGCGECPACHLRSKGYEEYMVMKGERA

SEQ ID NO: 294 - protein, 243 aa, Bacillus subtilis
MAKGIPVLEIFGPTIQGEGMVIGQKTMFVRTAGCDYSCSWCDSAFTWDGSAKKDIRWMTAEEIFAELKDIGGDAFSHVTISGGNPALLKQLDAFIELLKENNIRAALETQGTVYQDWFTLIDDLTISPKPPSSKMVTNFQKLDHILTSLQENDRQHAVSLKVVIFNDEDLEFAKTVHKRYPGIPFYLQVGNDDVHTTDDQSLIAHLLGKYEALVDKVAVDAELNLVRVLPQLHTLLWGNKRGV

SEQ ID NO: 295 - protein, 637 aa, Bacillus subtilis
MNEQVIVQRDPHEPLKTDKREKNWAQHAELIAALVSGALILAGWLLSGYQVLSIILFLLAFVIGGFAKAKEGIEETLESKTLNVELLMIFAAIGSALIGYWAEGAILIFIFSLSGALETYTMNKSSRDLTSLMQLEPEEATLMVNGETKRVPVSDLQAGDMIVIKPGERVAADGIIESGSTSLDESALTGESMPVEKNTGDTVFTGTVNRNGSLTVRVTKANEDSLFRKIIKLVESAQNSVSPAQAFIERFENAYVKGVLIAVALLLFVPHFALGWSWSETFYRAMVFMVVASPCALVASIMPAALSLISNGARNGMLVKGSVFLEQLGSVQMIAFDKTGTVTKGQPAVETIRIAEGFSEAEVLEAVYAIETQSSHPLAQAITAYAESRGVNQSGYISIEETSGFGVMAEVSGAKWKVGKAGFIGEEMAAQFMKQTASDVIQSGHTIVFVKKDDQIAGCIALKDQIRPEAKEVMEELNRLGIKTAMLTGDHEDTAQAIAKEAGMTTVVAECLPDQKVNEIKRLKEEFGTIAMVGDGINDAPALKAADVGIAMGGGTDVALETADMVLMKNDLKKLVNMCRLSRKMNRIIKQNIVFSLAVICLLICANFLQAMELPFGVIGHEGSTILVILNGLRLLK

SEQ ID NO: 296 - protein, 282 aa, Bacillus subtilis
MAKNKKLFEYLSQHAETISSTWYETIEETDPNSIYASTDPVVIHNLKSQNLAFNYKINRIFIDDEDVYLPILKEWAFEVTQDQEHLKTPIHYIIREFVRVRDLYVSYVKEFVHLNQNTVKSEEAEDLYHALIKAFDLVIHIFIEEMYKNTSLQLQAQKDMITELSAPVIVLFHSVGLLPLIGDIDTVRAKLIMENTLHQCAKKKVTQLYIDLSGVAVIDTMVAHQLFSLIEALRLIGVSSTLSGIRPEIAQTAVQLGLSFEGISLRSTLASAIASDLKLKKV

SEQ ID NO: 297 - protein, 789 aa, Bacillus subtilis
MHKHIRKAAVLGSGVMGSGIAAHLANIGIPVLLLDIVPNDLTKEEEKKGLTKDSSEVRSRLSRQAMKKLLKQKPAPLTSAKNTSYITPGNLEDDAEKLKEADWIIEVVVENLEVKKKIFALVDEHRKTGSIVSSNTSGISVQEMAEGRSDDFKAHFLGTHFFNPARYLKLLEIIPIKETDPDILKFMTAFGENVLGKGVVTAKDTPNFIANRIGTYGLLVTVQEMLKGGYQVGEVDSITGPLIGRPKSATFRTLDVVGLDTFAHVARNVYDKADGDEKEVFRIPSFMNDMLEKGWIGSKAGQGFYKKEGKTIYELDPVTLTYGERTKMKSPALEAAKQAKGTKAKMKALIYSDDRAGRLLWNITSQTLLYSAELLGEIADDIHAIDQAMKWGFGWELGPFEMWDAIGLKQSAEKLEQLGADMPGWIKEMLDKGNETFYIKENGTVFYYDRGEYRAVKENKKRIHLQALKETKGVIAKNSGASLIDLGDDVALLEFHSKSNAIGLDIIQMIHKGLEETERNYKGLVIGNQGKNFCVGANLAMILMEVQDDNFLEVDFVIRRFQETMMKIKYSAKPVVAAPFGMTLGGGTEACLPAARIQAASEAYMGLVESGVGLIPGGGGNKELYINHLRRGHDPMNAAMKTFETIAMAKVSASAQEAREMNILKETDQISVNQDHLLYDAKQLAASLYDTGWRPPVKEKVKVPGETGYAALLLGAEQMKLSGYISEHDFKIAKKLAYVIAGGKVPFGTEVDEEYLLEIEREAFLSLSGEAKSQARMQHMLVKGKPLRN

SEQ ID NO: 298 - protein, 702 aa, Bacillus subtilis
MRLVKQEYVLDGLDCSNCARKIENGVKGIKGINGCAVNFAASTLTVSADGKEEQWVTNKVEKKVKSIDPHVTVRQKHIKKSADDGYRNRMVNMLIRMAAAVILGAAAYLVQSGTIEFFLFLGAYLIIGGDIIIRAVKNIIRGQVFDEHFLMALATIGAFLIQQYPEGVAVMLFYQIGELFQGAAVSRSRKSISALMDIRPDYANLKTKNGIEQVSSEDVQTGDIIVVNPGESIPLDGKVVQGSAMVDTSALTGESVPRKAAEGQDVMSGFINQNGVLHIEVTKGYQESAVSKILDLVQNASSRKARTENFITKFAKYYTPAVVIIAVLLAFVPPLVLSGAALSDWVYRALIFLVISCPCALVVSIPLGFFGGIGAASKAGVLVKGSNYLEALNQVKYAVFDKTGTLTKGSFEVTEIKPAEGFTKDRLLEAAAYAELHSQHPIAESVRKAYGKMLSSDEIESYEEISGHGIFAKVNGTEILAGNKKLMEREQIEDVPDENAGTIVHVAVDQRYAGAIIIADEIKEDAAQAVADLKSLGIKQTAMLTGDSKQTGEAVGKQLGIGEVYAELLPQDKVAQVEALEAKLLPSEKLIFVGDGINDTPVLARADIGVAMGGLGSDAAVEAADIVLMTDQPSKIAEAIRIAKRTRRIVWQNIGFALGVKAIFLILGAFGIATMWEAVFSDVGVTLLAVANAMRVMRLKNK

SEQ ID NO: 299 - protein, 802 aa, Bacillus subtilis
MSEQKEIAMQVSGMTCAACAARIEKGLKRMPGVTDANVNLATETSNVIYDPAETGTAAIQEKIEKLGYHVVTEKAEFDIEGMTCAACANRIEKRLNKIEGVANAPVNFALETVTVEYNPKEASVSDLKEAVDKLGYKLKLKGEQDSEAAAKKKEERKQTARLIFSAVLSFPLLWAMVSHFTFTSFIWVPDIFLNPWMQFALATPVQFLIGWPFYVGAYKALRNKSANMDVLVALGTTAAYAYSLYLTFQSIGSHGHTDGLYYETSAILLTLILLGKLFETKAKGRSSDAIKKLMKLQAKTATVVRDGQEQIIPIDEVLVNDIVYVKPGERIPVDGEVVEGRSAVDESMITGESLPVDKNPGDSVTGSTVNANGFLKIKAVNVGKDTALSHIIKIVEEAQGSKAPIQRLADQISGIFVPIVLGIAVLTFLIWYLWAAPGDFAEAISKFIAVLVIACPCALGLATPTSIMAGSGRAAEFGILFKGGEHLEKTHRLDTIVLDKTGTVTNGKPRLTDAIPFGRFEEKDLLQFAAAAETGSEHPLGEAIIAGVKDKGLEIPKLTRFEAKVGAGILAEAGGKSILVGTRKLMESEQVEHGALLAQMEELEAEGKTVMLVSIDGEAAGLVAVADTIKDTSRKAVARLKELGLDVIMMTGDNRRTAEAIAKEAGIANIIAEVLPEQKAAEIARLQKEGRQTAMVGDGINDAPALATADIGMAIGTGTDIAMETADITLIRGDLNSIADAIRMSRLTMKNIKQNLFWALGYNSLGIPIAALGFLAPWIAGAAMAFSSVSVVLNALRLQKVK

SEQ ID NO: 300 - protein, 461 aa, Bacillus subtilis
MKKIAVIGTGYVGLVSGTCFAEIGNKVVCCDIDESKIRSLKNGVIPIYEPGLADLVEKNVLDQRLTFTNDIPSAIRASDIIYIAVGTPMSKTGEADLTYVKAAAKTIGEHLNGYKVIVNKSTVPVGTGKLVQSIVQKASKGRYSFDVVSNPEFLREGSAIHDTMNMERAVIGSTSHKAAAIIEELHQPFHAPVIKTNLESAEMIKYAANAFLATKISFINDIANICERVGADVSKVADGVGLDSRIGRKFLKAGIGFGGSCFPKDTTALLQIAKSAGYPFKLIEAVIETNEKQRVHIVDKLLTVMGSVKGRTISVLGLAFKPNTNDVRSAPALDIIPMLQQLGAHVKAYDPIAIPEASAILGEQVEYYTDVYAAMEDTDACLILTDWPEVKEMELVKVKTLLKQPVIIDGRNLFSLEEMQAAGYIYHSIGRPAVRGTEPSDKYFPGLPLEELAKDLGSVNL

SEQ ID NO: 301 - protein, 890 aa, Bacillus subtilis
MKFHEMGQTDLLEATNTSMKQGLTEKEVKKRLDKHGPNELQEGKKTSALLLFFAQFKDFMVLVLLAATLISGFLGEYVDAVAIIAIVFVNGILGFFQERRAEQSLQALKELSTPHVMALREGSWTKIPSKELVPGDIVKFTSGDRIGADVRIVEARSLEIEESALTGESIPVVKHADKLKKPDVSLGDITNMAFMGTIVTRGSGVGVVVGTGMNTAMGKIADMLESAGTLSTPLQRRLEQLGKILIVVALLLTVLVVAVGVIQGHDLYSMFLAGVSLAVAAIPEGLPAIVTVALSLGVQRMIKQKSIVRKLPAVETLGCASIICSDKTGTMTQNKMTVTHVWSGGKTWRVAGAGYEPKGSFTLNEKEISVNEHKPLQQMLLFGALCNNSNIEKRDGEYVLDGDPTEGALLTAARKGGFSKEFVESNYRVIEEFPFDSARKMMTVIVENQDRKRYIITKGAPDVLMQRSSRIYYDGSAALFSNERKAETEAVLRHLASQALRTIAVAYRPIKAGETPSMEQAEKDLTMLGLSGIIDPPRPEVRQAIKECREAGIKTVMITGDHVETAKAIAKDLRLLPKSGKIMDGKMLNELSQEELSHVVEDVYVFARVSPEHKLKIVKAYQENGHIVAMTGDGVNDAPAIKQADIGVSMGITGTDVAKEASSLVLVDDNFATIKSAIKEGRNIYENIRKFIRYLLASNVGEILVMLFAMLLALPLPLVPIQILWVNLVTDGLPAMALGMDQPEGDVMKRKPRHPKEGVFARKLGWKVVSRGFLIGVATILAFIIVYHRNPENLAYAQTIAFATLVLAQLIHVFDCRSETSVFSRNPFQNLYLIGAVLSSILLMLVVIYYPPLQPIFHTVAITPGDWMLVIGMSAIPTFLLAGSLLTRKK

SEQ ID NO: 302 - protein, 75 aa, Bacillus subtilis
MLRKKHFSWMLVILILIAVLSFIKLPYYITKPGEATELASLIKVEGGYPEKGSLSLMTVKVGPANPFTYVWAKMH

SEQ ID NO: 303 - protein, 76 aa, Bacillus subtilis
HFSWMLVILILIAVLSFIKLPYYITKPGEATELASLIKVEGGYPEKGSLSLMTVKVGPANPFTYVWAKMHPYYEIV

SEQ ID NO: 304 - protein, 126 aa, Bacillus subtilis
MEKKKYNISVEATLEVIGGKWKCVILCHLTHGKKRTSELKRLMPNITQKMLTQQLRELEADGVINRIVYNQVPPKVEYELSEYGRSLEGILDMLCAWGANHINRVYGDTFSVLEESVLNDKLKQES

SEQ ID NO: 305 - protein, 344 aa, Bacillus subtilis
MKNTMKRMFCSMTVLVTAPYNEEGRKELENLFGSVAYQSWKEQGRAYREDELIQLLKATNATGLITELDQVTDSVFASVPELSFVGVCRGMPSNVDVAAASKRGIPVFYTPGRNAQAVAEMFIGNVISFLRHTSASNQWLKDGEWDSDYLQAYVKFKGNELTGKTVGMIGFGAVGQRIAKLLTAFDCKIKYYDPYIQDDHPLYEKASLKTVFSDSDIVSVHLPRTEETLGLIDRQYFDLMKESAIFVNTSRAVVVNREDLLFVLKEHKISGAILDVFYHEPPEESDYELISLPNVLATPHLAGATFEVEDHHVTILNKALKKWKGEKTLNIQTMYNKDALKTGG

SEQ ID NO: 306 - protein, 319 aa, Bacillus subtilis
MKGVFSLNYKPKALNKGDTVGVIAPASPPDPKKLDTALLFLEELGLQVKLGKALKNQHGYLAGQDDERLADLHEMFRDDEVKAVLCACGGFGTGRIAAGIDFSLIRKHPKIFWGYSDITFLHTAIHQNTGLVTFHGPMLSTDIGLDDVHPLTKASYKQLFQETEFTYTEELSPLTELVPGKAEGELVGGNLSLLTSTLGTPFEIDTRGKLLFIEDIDEEPYQIDRMLNQLKMGGKLTDAAGILVCDFHNCVPVKREKSLSLEQVLEDYIISAGRPALRGFKIGHCSPSIAVPIGAKAAMNTAEKTAVIEAGVSEGALKT

SEQ ID NO: 307 - protein, 296 aa, Bacillus subtilis
MIKILGRHLRESFKSLGRNTWMTFASISAVTVTLILVGVFLVIMLNLNNMATNAEKQVEIKVLIDLTADQKAQDKLQNDIKELKGIQSVTFSSKEKELDQLVDSFGDSGKSLTMKDQENPLNDAFVVKTTDPHDTPNVAKKIEKMDHVYKVTYGKEEVSRLFKVVGVSRNIGIALIIGLVFTAMFLISNTIKITIFARRKEIEIMKLVGATNWFIRWPFFLEGLLLGVFGSVIPIALVLSTYQYVIGWVVPKVQGSFVSLLPYNPFVFQVSLVLIAIGAVIGVWGSLTSIRKFLRV

SEQ ID NO: 308 - protein, 231 aa, Bacillus subtilis
MNLVSLKDIVFGYSHTPVLDKVSLDIESGEFVGITGPNGASKSTLIKVMLGMLKPWEGTVTISKRNTEGKRLTIGYVPQQISSFNAGFPSTVLELVQSGRYTKGKWFKRLNEEDHLEVEKALKMVEMWDLRHRKIGDLSGGQKQKICIARMLASNPDLLMLDEPTTAVDYDSRKGFYEFMHHLVKNHNRTVVMVTHEQNEVQQFLDKVIRLERGEKGGWKCLTWNSCDELF

SEQ ID NO: 309 - protein, 349 aa, Rattus norvegicus
MAGKKVCIVGSGNWGSAIAKIVGSNASQLAHFDPRVTMWVFEEDIGGRKLTEIINTQHENVKYLPGHKLPPNVVAVPDVVQAATGADILVFVVPHQFIGKICDQLKGHLKANTIGISLIKGIDEGPNGLKLISEVIGESLGIPMSVLMGANIASEVAEEKFCETTIGCKDPAQGQLLKELMQTPNFRITVVQEVDTVEICGALKNIVAVGAGFCDGLGFGDNTKAAVIRLGLMEMIAFAKLFCSGSVSSATFLESCGVADLITTCYGGRNRKVAEAFARTGKSIEQLEKEMLNGQKLQGPQTARELHSILQHKGLVDKFPLFTAVYKVCYEGQPVGEFICCLQNHPEHM

SEQ ID NO: 310 - protein, 34 aa, Rattus norvegicus
WSIIATAVLLPCAFLKNLKAVSKFSLLCTLAHFV

SEQ ID NO: 311 - protein, 123 aa, Rattus norvegicus
ATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEV

SEQ ID NO: 312 - protein, 620 aa, Mus musculus
MLPVLYTGLAGLLLLPLLLTCCCPYLLQDVRYFLRLANMARRVRSYRQRRPVRTILRAFLEQARKTPHKPFLLFRDETLTYAQVDRRSNQVARALHDQLGLRQGDCVALFMGNEPAYVWIWLGLLKLGCPMACLNYNIRAKSLLHCFQCCGAKVLLASPDLQEAVEEVLPTLKKDAVSVFYVSRTSNTNGVDTILDKVDGVSAEPTPESWRSEVTFTTPAVYIYTSGTTGLPKAATINHHRLWYGTGLAMSSGITAQDVIYTTMPLYHSAALMIGLHGCIVVGATLALRSKFSASQFWDDCRKYNVTVIQYIGELLRYLCNTPQKPNDRDHKVKKALGNGLRGDVWREFIKRFGDIHVYEFYASTEGNIGFVNYPRKIGAVGRANYLQRKVARYELIKYDVEKDEPVRDANGYCIKVPKGEVGLLVCKITQLTPFIGYAGGKTQTEKKKLRDVFKKGDIYFNSGDLLMIDRENFVYFHDRVGDTFRWKGENVATTEVADIVGLVDFVEEVNVYGVPVPGHEGRIGMASLKIKENYEFNGKKLFQHIAEYLPSYARPRFLRIQDTIEITGTFKHRKVTLMEEGFNPTVIKDTLYFMDDAEKTFVPMTENIYNAIIDKTLKL

SEQ ID NO: 313 - protein, 34 aa, Mus musculus; identical to SEQ ID NO: 310

SEQ ID NO: 314 - protein, 123 aa, Mus musculus; identical to SEQ ID NO: 311

SEQ ID NO: 315 - protein, 34 aa, Mus musculus; identical to SEQ ID NO: 310

SEQ ID NO: 316 - protein, 123 aa, Mus musculus; identical to SEQ ID NO: 311

SEQ ID NO: 317 - protein, 943 aa, Mus musculus
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYATLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPNAFVEGGRGVVHKSLPPRTASSESTESPETAPAGAPAGDQPDVIPAQGDLLGDLLNLDLGPPVSGPPLAASSVQMGAVDLLGGGLDSLIGDSNFGAPSASVAAAPAPARLGAPISSGLSDLFDLTSGVGTLSGSYVAPKAVWLPAMKAKGLEISGTFTRQAGSISMDLQLTNKALQVMTDFAIQFNRNSFGLAPAAPLQVHVPLSPNQTVEISLPLNTVGSVLKMEPLNNLQVAVKNNIDVFYFSTLYPLHVLFVEDGKMDRQMFLATWKDIANENEAQFQIRDCPLNTEAASNKLQSSNIFTVAKRNVEGQDMLYQSLKLTNGIWVLAELRIQPGNPSFTLSLKCRAPEVSQHVYQAYETILKN

SEQ ID NO: 318 - protein, 155 aa, Rattus norvegicus
KVLSVLVWVLMLLLAVPNIILTNQSVKDVTNIQCMELKNELGRKWHKASNYVFVSIFWIVFLLLTVFYMAITRKIFKSHLKSRKNSISVKRKSSRNIFSIVLAFVACFAPYHVARIPYTKSQTEGHYSCQAKETLLYTKEFTLLLSAANVCLDPI

SEQ ID NO: 319 - protein, 148 aa, Rattus norvegicus
VLVWVLMLLLAVPNIILTNQSVKDVTNIQCMELKNELGRKWHKASNYVFVSIFWIVFLLLTVFYMAITRKIFKSHLKSRKNSISVKRKSSRNIFSIVLAFVACFAPYHVARIPYTKSQTEGHYSCQAKETLLYTKEFTLLLSAANVCL

SEQ ID NO: 320 - protein, 79 aa, Haplochromis nubilus
CISRVYMAAHFPHQVIAGIITGTLVAEVVSKEKWIYSASLKKYFLITLFLTSFAVGFYVLLKALDVDLLWTMEKAQKWC

SEQ ID NO: 321 - protein, 94 aa, Haplochromis nubilus
MAAHFPHQVIAGIITGTLVAEVVSKEKWIYSASLKKYFLITLFLTSFAVGFYVLLKALDVDLLWTMEKAQKWCIRPEWVHLDSAPFASLLRNMG

SEQ ID NO: 322 - protein, 79 aa, Haplochromis xenognathus; identical to SEQ ID NO: 320

SEQ ID NO: 323 - protein, 94 aa, Haplochromis xenognathus; identical to SEQ ID NO: 321

SEQ ID NO: 324 - protein, 196 aa, Schizosaccharomyces pombe
TLMQLSNDMKPLTFVEALRNFKSAKVLLVGAGGIGCELLKNLLMSGVKEVHIIDLDTIDLSNLNRQFLFRKKHVKQPKAIVAAKTASSFNPNVKLEAYHANIKEDRFNVAWFRQFDLVFNALDNLDARRHVNKQCLLASVPLIESGTTGFLGQVQVIIHGKTECYDCNPKEPPKTYPVCTIRSTPSQPIHCVVWAK

SEQ ID NO: 325 - protein, 194 aa, Schizosaccharomyces pombe
MVSRWEKLKNNPQTKSIGISIFLMMITRVIDFSRPSLLWPLRILYATVNIVQIGIFLYTKIIIEKKNDLTVLKYVEPATPMSGREHSKFVATTVRDYDLSKLLTSFKQMLVTIATTLFMHLYMGYAPPLLLQSVSAARGLFDNSEVQIHVQNKPAIDELRRPFKSSGGLLGSFGQVLTDKKSVDEAELTKLKPT

SEQ ID NO: 326 - protein, 36 aa, Schizosaccharomyces pombe
GGELCSLRYDLTVPFARWLAMNPKVTSIKRFHIAKV

SEQ ID NO: 327 - protein, 33 aa, Schizosaccharomyces pombe
LCSLRYDLTVPFARWLAMNPKVTSIKRFHIAKV

SEQ ID NO: 328 - protein, 103 aa, Schizosaccharomyces pombe
TKLVLSKEQMPRTLKAIALDPQGNYVSLFSKDTLFILNVESPCLMLQHSYHCKPNSKLNVFWMPGTHKDDEWKNFELVVVESSGEIQVFSLTIEIEGADIALV

SEQ ID NO: 329 - protein, 81 aa, Schizosaccharomyces pombe
FMGLLTLPTSEHDVYFNATRVLVYKLKHHPETKSKYPVHVLVMKGVDEWKIERLRLDGAEIIMVDQIKTEDLIESGLSIGM

SEQ ID NO: 330 - protein, 100 aa, Schizosaccharomyces pombe
NATRVLVYKLKHHPETKSKYPVHVLVMKGVDEWKIERLRLDGAEIIMVDQIKTEDLIESGLSIGMGSYRYQYMFTKLSVFEQTQFDKVCILDSDLLVLKN

SEQ ID NO: 331 - protein, 1953 aa, Schizosaccharomyces pombe
MTTRLDRLVVLLDSGSTSVVRETAAKQIGDIQKVHPDELYNLLGRVVPYLKSKNWDTRVAAAKAIGGIVENVPVWNPNRTSPVKKEETEDLPSFNGDTEEKPFIKTEEGAPASSQSQVVVSSNLTSNSEVSKLEEERLSTRSHSQEIKPIVDFGPDEETAKELNTELKGKFENSLLSFESFDIANVLKAGKKLLGSASRDYDVNPANYSTHYLQQLSNLKSRLDLAGEYLDDSIMNDLGDNVGSNSKGSPTTSIPEHKTSINNNKPEDTPTPSENVHLSARQRNALKRKARQMKNSQKVRVIDVAPTLVHQQNSTSSADKKTGADYNFTAQSRSDRLVVEHKAPIVPSAAVAVTSDSVWPFETLVELLLIDMFDPSWEIRHGACMGLREIIRYAGFGYGRVVGKSEAENEQLNKKYFDDLLCRIACVFALDRFGDYLADQVVAPIRESVSQVLGVALIYVPNDSVFSMYKVLHSLVFQNELGLTNTVWEAAHGGMLGIKYLVAVKYPLFFSHSDYLDSLINTVIHGLANHDDDVRAVSALTLLPIADKLVQEKLSSCKNLLKVLWDCLDDVKDDLSSSTSCVMDLLSSLCSFTEVMNLMQETANSDPEFSFETLVPRLFHLMRYTLTGVRRSVVYALTKFISVQTSCSWITGLTLRLCFQNVLLEQQEDISKSSCELAQRVMDILYRDGPESFSKLLYSHIEPMLKVSITPIGSFRRPYPLDTTLIVKPSGQPYAPSTSRERNNNISELSNSRTKHRAKDDPKGSFCFSVDEPMLNGDVEFVGEERMLKARLRASSLLGRIIGRWKRDEILLFFKPFLQACLTSSFSTPVVLGSRLIESFFEVEDNDLTIQKDELYHLLCDQFATVPRENYANLVSQLHVVRAQCNALLNTFLDVGRLSRSKIPSLAVVVKGDPEAGPIAFGIADAEKLVGPTYENLCKLLSPSQKAQSSKALNEIKYLIIDEISIYKIAKERQDIQCSASIASAMVTYDKLPKKLNSIIKGIMESIKKEQFSCLQMHSASAMMKLISACYKESRQVISEKIVRNLCAYVCMDTTETPIFHDSGKNGILSLHSIGTSDDNDEQVSGKLVDDSDDVSNDRKSSLSSVSDKDAAVLQRMGAQLTLQQMAQNFGSSLFSRVPVLSQCLFVPLQQYAESGFPSEVDQASCTVGQDLLDAMSILRFLVAYLDSGLQSEIVSTLPHLLATLQSNYSAVRNMASKCFAAITESNAAGSKALHLLVEDVVPLLGDASSTIHRQGAIECIYHVVQRLGVRILPYILYLIIPLLGRMSDADQDVRVLATTSFATLVKLVPLEAGLPDPPDLPQYLLDSREKERKFLEQMLNPSKVEAFSIPVPISADLRKYQQEGVNWLAFLNKYELHGILCDDMGLGKTLQTICIVASDHYNRQKLFEESGSPKFAHVPSLIVCPSTLAGHWQQELSTYAPFLKVSAYVGPPAERAKIRSKMKKSDVVVTSYDICRNDVDELVKIDWNYCVLDEGHVIKNARAKLTKAVKSLRSYHRLILSGTPIQNNVLELWSLFDFLMPGFLGTEKTFQERFVRPIAASRDAKSSSKERERGTLALEAIHKQVLPFMLRRLKEDVLADLPPKIIQDYYCDMSDLQRKLLNDFVSQLNINEELEDDETEKTQGTRKKKSQKAHIFQALQYMRKLCNHPALILTEKHPKRNAIVKQLAKENSGLHDLKHAPKLTALGQLLRDCGLGNSSVNSNGIDSALTNAVSEHRVLIFCQLKDMLDMVEKDLLQATMPDVTYMRLDGSVEPTKRQEAVTKFNNDPSIDVLLLTTHVGGLGLNLTGADTVIFVEHDWNPMRDLQAMDRAHRIGQKKVVNVYRLITRGCLEEKIMGLQRFKMNVASTVVNQQNAGLSSIGTDQILDLFNTTADEQQTVQNIDKEESEDAAGRGLSGTSKKALEGLPEMWDESQYDEFNLDGFISTLPKDAS

SEQ ID NO: 332 - protein, 551 aa, Schizosaccharomyces pombe
MSVSKARLQSVVRLSRTVPYSKTMVRSFHVSCAVKNSGNVPTPRNKSFFSRALEMAEVTSSLSMLGAVALFQSLRRLNNSSPKGKSGVPKKNIVVLGSGWGAVAAIKNLDPSLYNITLVSPRDHFLFTPMLPSCTVGTLRLPSITEPIVALFKGKIDPSNIHQAECTAIDTSAKKVTIRGTTEANEGKEAVIPYDTLVFAIGAGNQTFGIQGVRDHGCFLKEAGDAKKVFNRIFEILEQVRFNKDLSPEERARLLHITVVGGGPTGMEFAAEMQDFIDNDVKDMFPELQKDIHVTLIEAAPGVLPMFTKSLITYTENLFKNLNIKIMTKTVVKDVNEKNLIVQKTNPDGSKAMQEIPYGMLVWAAGITARPLTRTLMSSIPEQSGARKGLIVDEFFRVKGVPEMYAVGDCAFSGLPATAQVANQQGAWLAKNLNVEGKKFALHERIQALEKQLGEKEAPSQVAGLKQQVEQLKLEPFKYHHQGALAYVGDEKAIADLKLPFMKKMLPLQGIVGHTFWRLAYLNELISARSQFMVLIDWLKTRLFGRYDAKV

SEQ ID NO: 333 - protein, 760 aa, Caenorhabditis elegans
MAAVQKKQKAAHEPPANSIVNIPSQVSIEVLGNGTGLLRACFILRTPLKTYMFNCPENACRFLWQLRIRSSSVVDLFITSANWDNIAGISSILLSKESNALSTRLHGAMNIKHFLECIRPFQDSDYGSCKYPSQVEERPYTMENYEDAGLKVTYIPLSPPLNIGSNNEKSKNVKVNNVDIAFLIEMKEAARRIDTMKLMELKVPKGPLIGKLKSGEAVTLPDGRTIQPDQVFSSDKVEGDKPLLLVTECTTEDHVKALIDSSSLQPFLNGEKQLDYMVHISDDAVINTPTYRHLMEKLNNPSITHLLINGGNPVIPAVESVYKHTRLLRSIAPSLFPALHPIDWSGIITQNEELSQRQDQFIRVAPMQRYWMRRGASFNEEPIVNNLLAAEPELSDKAKELIKEYQKLEKENKMDCEFPKLTFFGTSSAVPSKYRNVTGYLVEASENSAILIDVGEGTYGQMRAVFGEDGCKQLLVNLNCVLITHAHQDHMNGLYTIIARRKEAFESLGAPYRPLVLVCNRNVLKPMKTYSICFENIEHLLEIVDISRYPLTPPGSPGGPPGKRPRLPSPHLPPSRDVLQDMSSSFDKKAWKLDELKAVQVHHTRMANGFVMRVAGKRIVFSGDTKPCDLLVEEGKDADVLVHESTFEDGHEADAMRKRHSTMGQAVDVGKRMNAKHIILTHFSARYPKVPVLPEYLDKENIGVAMDMLRVRFDHLPLVSKLLPIFREVFVAELFELTIKKEQRVLKDKELSEKRGQLKA

SEQ ID NO: 334 - protein, 503 aa, Equus caballus
MILEMLNPMHYNLTSMVPEVMPVATLPILLLTGFLFFVWNHEETSSIPGPGYCMGIGPLISHLRFLWMGLGSACNYYNKMYGEFVRVWISGEETLVISKSSSTFHIMKHDHYSSRFGSTFGLQYMGMHENGVIFNNNPAVWKALRPFFVKALSGPSLARMVTVCVESVNNHLDRLDEVTNALGHVNVLTLMRRTMLDASNTLFLRIPLDEKNIVLKIQGYFDAWQALLIKPNIFFKISWLSRKHQKSIKELRDAVGILAEEKRHRIFTAEKLEDHVDFATDLILAEKRGELTKENVNQCILEMMIAAPDTLSVTVFFMLCLIAQHPKVEEALMKEIQTVLGERDLKNDDMQKLKVMENFINESMRYQPVVDIVMRKALEDDVIDGYPVKKGTNIILNIGRMHKLEFFPKPNEFTLENFEKNVPYRYFQPFGFGPRSCAGKFIAMVMMKVMLVSLLRRFHVKTLQGNCLENMQKTNDLALHPDESRSLPAMIFTPRNSEKCLEH

SEQ ID NO: 335 - protein, 379 aa, Oryctolagus cuniculus
MGTKGKVIKCKAAIAWEAGKPLSIEEVEVAPPKAHEVRVQINAAGLCRSDTHVINPKFEGAFLPVILGHEGAGIVESVGPGVTNVKPGDKVIPLYIPHCKKCKFCLSPLTNFCEKFCKGKNPLIEQELMEDKTSRFTCKGKSIYHFFGISAFSQYTVVKDVNLAKIDDDANLERVCLIGCGFSTGYGAAINTAKVTPGSTCAVFGLGGVGLSAIMGCKTAGASRIIAIDINSDKFAKAKALGATDCLNPRELNKPVQDVIVEMTNGGVDFAIDCAGGSEVMKATVDCATVGWGSCTFVGVNLADKGLTISPIELILGRTLKGTNFGGWDAETVPKLVSDYKNGKFDLDALVTHTLPFDKINEALNLLDQGKSIRTVLIF

SEQ ID NO: 336 - protein, 147 aa, Pisum sativum
MGFTDKQEALVNSSWESFKQNLSGNSILFYTIILEKAPAAKGLFSFLKDTAGVEDSPKLQAHAEQVFGLVRDSAAQLRTKGEVVLGNATLGAIHVQRGVTDPHFVVVKEALLQTIKKASGNNWSEELNTAWEVAYDGLATAIKKAMT

SEQ ID NO: 337 - protein, 460 aa, Arabidopsis thaliana
MAETTPKVKGHVVILPYPVQGHLNPMVQFAKRLVSKNVKVTIATTTYTASSITTPSLSVEPISDGFDFIPIGIPGFSVDTYSESFKLNGSETLTLLIEKFKSTDSPIDCLIYDSFLPWGLEVARSMELSAASFFTNNLTVCSVLRKFSNGDFPLPADPNSAPFRIRGLPSLSYDELPSFVGRHWLTHPEHGRVLLNQFPNHENADWLFVNGFEGLEETQDCENGESDAMKATLIGPMIPSAYLDDRMEDDKDYGASLLKPISKECMEWLETKQAQSVAFVSFGSFGILFEKQLAEVAIALQESDLNFLWVIKEAHIAKLPEGFVESTKDRALLVSWCNQLEVLAHESIGCFLTHCGWNSTLEGLSLGVPMVGVPQWSDQMNDAKFVEEVWKVGYRAKEEAGEVIVKSEELVRCLKGVMEGESSVKIRESSKKWKDLAVKAMSEGGSSDRSINEFIESLGK

SEQ ID NO: 338 - protein, 389 aa, Arabidopsis thaliana
MELGKSIENQNNVVARLAKKVIETDVANGSNVVFSPMSINVLLSLIAAGSNPVTKEEILSFLMSPSTDHLNAVLAKIADGGTERSDLCLSTAHGVWIDKSSYLKPSFKELLENSYKASCSQVDFATKPVEVIDEVNIWADVHTNGLIKQILSRDCTDTIKEIRNSTLILANAVYFKAAWSRKFDAKLTKDNDFHLLDGNTVKVPFMMSYKDQYLRGYDGFQVLRLPYVEDKRHFSMYIYLPNDKDGLAALLEKISTEPGFLDSHIPLHRTPVDALRIPKLNFSFEFKASEVLKDMGLTSPFTSKGNLTEMVDSPSNGDKLHVSSIIHKACIEVDEEGTEAAAVSVAIMMPQCLMRNPDFVADHPFLFTVREDNSGVILFIGQVLDPSKH

SEQ ID NO: 339 - protein, 520 aa, Arabidopsis thaliana
MEEESSSWFIPKVLVLSVILSLVIVKGMSLLWWRPRKIEEHFSKQGIRGPPYHFFIGNVKELVGMMLKASSHPMPFSHNILPRVLSFYHHWRKIYGATFLVWFGPTFRLTVADPDLIREIFSKSEFYEKNEAHPLVKQLEGDGLLSLKGEKWAHHRKIISPTFHMENLKLLVPVVLKSVTDMVDKWSDKLSENGEVEVDVYEWFQILTEDVISRTAFGSSYEDGRAVFRLQAQQMLLCAEAFQKVFIPGYRFFPTRGNLKSWKLDKEIRKSLLKLIERRRQNAIDGEGEECKEPAAKDLLGLMIQAKNVTVQDIVEECKSFFFAGKQTTSNLLTWTTILLSMHPEWQAKARDEVLRVCGSRDVPTKDHVVKLKTLSMILNESLRLYPPIVATIRRAKSDVKLGGYKIPCGTELLIPIIAVHHDQAIWGNDVNEFNPARFADGVPRAAKHPVGFIPFGLGVRTCIGQNLAILQAKLTLAVMIQRFTFHLAPTYQHAPTVLMLLYPQHGAPITFRRLTNHED

SEQ ID NO: 340 - protein, 387 aa, Arabidopsis thaliana
MASSRVSDLPHQRGIAGEIKPKNVAGHGRQNRKVLGDIGNLVTGRDVATGKDVAKKAKQPQQQTKAEVIVISPDENEKCKPHFSRRTHIRGTKTFTATLRARSKAASGLKDAVIDIDAVDANNELAAVEYVEDIFKFYRTVEEEGGIKDYIGSQPEINEKMRSILIDWLVDVHRKFELMPETLYLTINLVDRFLSLTMVHRRELQLLGLGAMLIACKYEEIWAPEVNDFVCISDNAYNRKQVLAMEKSILGQVEWYITVPTPYVFLARYVKAAVPCDAEMEKLVFYLAELGLMQYPIVVLNRPSMLAASAVYAARQILKKTPFWTETLKHHTGYSEDEIMEHAKMLMKLRDSASESKLIAVFKKYSVSENAEVALLPSLDDFSVSCA

SEQ ID NO: 341 - protein, 66 aa, Glycine max
ISTPSNSGILRFAKKQLPALVVKLYLARVITLSVHIAKEGRLSCTVKQYLKCLSWRCFLGGCGHSV

SEQ ID NO: 342 - protein, 30 aa, Glycine max
VITLSVHIAKEGRLSCTVKQYLKCLSWRCF

SEQ ID NO: 343 - protein, 437 aa, Medicago sativa
MALTQLNNTCSKTQLHSSSQLSFLSRTLPRHHHCTLAPLHRTQHARISCSVAPNQVQAPAVQTQDPKSKPDCYGVFCLTYDLKAEEETKSWKKLITIAVSGAAGMISNHLLFKLASGEVFGPNQPIALKLLGSERSLQALEGVAMELEDSLFPLLREVVISIDPYEVFQDAEWALLIGAKPRGPGMERAALLDINGQIFAEQGKALNAVASRNVKVIVVGNPCNTNALICLKNAPNIPAKNFHALTRLDENRAKCQLALKAGVFYDKVSNMTIWGNHSTTQVPDFLNARIDGLPVKEVIKDHKWLEEEFTEKVQKRGGALIQKWGRSSAASTSVSIVDAIRSLIIPTPEGDWFSTGVYTTGNPYGIAEDIVFSMPCRSKGDGDYELVKDVIFDDYLRQKLAKTEAELLAEKKCVAHLTGEGIAVCDLPGDTMLPGEM

SEQ ID NO: 344 - protein, 74 aa, Arabidopsis thaliana
FKEIVAARGKKGTARFELVDQLTHLTKIAKTPAQKLEILFSVISAQFDVNPGLSGHMPINVWKKCVLNMLTILD

SEQ ID NO: 345 - protein, 64 aa, Arabidopsis thaliana
FELVDQLTHLTKIAKTPAQKLEILFSVISAQFDVNPGLSGHMPINVWKKCVLNMLTILDILVKY

SEQ ID NO: 346 - protein, 128 aa, Solanum lycopersicum
VQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDV

SEQ ID NO: 347 - protein, 79 aa, Solanum lycopersicum
KRFVNLMEGHIWIESEGVGKGSTAIFIVKLGIPGRLNESKLPFTAGLPANHMQMTFQGLKVLVMDDNGFSRMVTKSLLV

SEQ ID NO: 348 - protein, 497 aa, Arabidopsis thaliana
MEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 349 - protein, 523 aa, Arabidopsis thaliana
MDTSLFSLFVPILVFVFIALFKKSKKPKHVKAPAPSGAWPIIGHLHLLSGKEQLLYRTLGKMADQYGPAMSLRLGSSETFVVSSFEVAKDCFTVNDKALASRPITAAAKHMGYDCAVFGFAPYSAFWREMRKIATLELLSNRRLQMLKHVRVSEISMVMQDLYSLWVKKGGSEPVMVDLKSWLEDMSLNMMVRMVAGKRYFGGGSLSPEDAEEARQCRKGVANFFHLVGIFTVSDAFPKLGWFDFQGHEKEMKQTGRELDVILERWIENHRQQRKVSGTKHNDSDFVDVMLSLAEQGKFSHLQHDAITSIKSTCLALILGGSETSPSTLTWAISLLLNNKDMLKKAQDEIDIHVGRDRNVEDSDIENLVYIQAIIKETLRLYPAGPLLGHREAIEDCTVAGYNVRRGTRMLVNVWKIQRDPRVYMEPNEFRPERFITGEAKEFDVRGQNFELMPFGSGRRSCPGSSLAMQVLHLGLARFLQSFDVKTVMDMPVDMTESPGLTIPKATPLEILISPRLKEGLYV

SEQ ID NO: 350 - protein, 512 aa, Arabidopsis thaliana
MDTSLFSLFVSILVFVFIALFKKSKKPKYVKAPAPSGAWPIIGHLHLLGGKEQLLYRTLGKMADHYGPAMSLRLGSSETFVGSSFEVAKDCFTVNDKALASLMTAAAKHMGYVFWLEMRKIAMIELLSNRRLQMLNNVRVSEISMGVKDLYSLWVKKGGSEPVMVDLKSWLEDMIANMIMRMVAGKRYFGGGGAESSEHTEEARQWRKGIAKFFHLVGIFTVSDAFPKLGWLDLQGHEKEMKQTRRELDVILERWIENHRQQRKVSGTKHNDSDFVDVMLSLAEQGKLSHLQYDANTCIKTTCLALILGGSETSPSTLTWAISLLLNNKDMLKKVQDEIDIHVGRDRNVEDSDIKNLVYLQAIIKETLRLYPAAPLLGHREAMEDCTVAGYNVPCGTRLIVNVWKIQRDPKVYMEPNEFRPERFITGEAKDFDVRGQNFELMPFGSGRRSCPGPSLAMQMLHLGLARFLHSFEVKTVLDRPVDMSESPGLTITKATPLEVLINPRLKRELFV

SEQ ID NO: 351 - protein, 431 aa, Arabidopsis thaliana
MAFSFDLAVIFQRERRMKRKSRVTIRRRRRRDMCKSHEPMPYIPFDLVIEILTRLPAKSLMRFKSVSKLWSSLICSRTFTNRLLRVPSFIQRLYVTLTFLDNSLQRKSKLLSSSSSPGSDISTMSSFVVDRDLTTPSMKGYYLSHVLRGLMCFVKEPSVKIYNTTTRQLVVLPDIEESNIIAEDHKNKKIMYRIGHDPVGDQYKVVCIVARPNDEFGELRRYLSEHWVFILGGDKSSGWRKIPCPSPHLPITQILSINGRMHYLAWVQKFDPMLVTFDFSSEEISILQAPEDIRWFKSNPIEYYGKVALLNLSDLKRECTMNLWVMEDVEKNMWSEKTLVVHPSQMDIVKSTSLRVAGTTRNNEVILVPHNIRYTLTGEVIVEPQNTTLLYIFLYDLQKNLMRKVEIKEPPYHTKFWDVVGLDDVENFMYL

SEQ ID NO: 352 - protein, 807 aa, Arabidopsis thaliana
MAERVEASSVPEGENTIEEREVGAMWELEQKLDQPMDEEANKLNNMYREKGLSMLMLLRLSFQSLGIVYGDLGTSPLYVFYNTFPDGIDDSEDVIGALSLIIYSLLLIPLIKYVFIVCKANDNGQGGTLAIYSLLCRHAKVKLIPNQHRSDEDLTTYSRTVSAEGSFAAKTKKWLEGKEWRKRALLVVVLLGTCMMIGDGILTPAISVLSATGGIKVNNPKMSGDIVVLVAIVILIGLFSMQHYGTDKVGWLFAPIVLIWFLFIGATGMYNICKYDTSVLKAFSPTYIYLYFKRRGRDGWISLGGILLSITGTEALYADIAYFPLLAIQLAFTFFVFPCLLLAYCGQAAYLVIHKEHYQDAFYASIPDSVYWPMFIVATGAAIVGSQATISGTYSIVKQAVAHGCFPRVKIVHTSKKFLGQIYCPDINWILMLGCIAVTASFKKQSQIGNAYGTAVVLVMLVTTLLMVLIMLLVWHCHWILVLIFTFLSFFVELSYFSAVIFKIDEGGWVPLIIAAISLLVMSVWHYATVKKYEFEMHSKVSMSWILGLGPSLGLVRVPGIGLVYTELASGVPHIFSHFITNLPAIHSVVVFVCVKYLPVYTVPEEERFLVKRIGPKTFRMFRCVARYGYKDLHKKDDDFENKLLTKLSSFIRIETMMEPTSNSSTYSSTYSVNHTQDSTVDLIHNNNNHNHNNNMDMFSSMVDYTVSTLDTIVSAESLHNTVSFSQDNTVEEEETDELEFLKTCKESGVVHIMGNTVVKARTGSWLPKKIAIDYVYAFLAKICRANSVILHVPHETLLNVGQVFYV

SEQ ID NO: 353 - protein, 140 aa, Arabidopsis thaliana
PLIKYVFIVCKANDNGQGGTLAIYSLLCRHAKVKLIPNQHRSDEDLTTYSRTVSAEGSFAAKTKKWLEGKEWRKRALLVVVLLGTCMMIGDGILTPAISVLSATGGIKVNNPKMSGDIVVLVAIVILIGLFSMQHYGTDK

SEQ ID NO: 354 - protein, 75 aa, Arabidopsis thaliana
KQAVAHGCFPRVKIVHTSKKFLGQIYCPDINWILMLGCIAVTASFKKQSQIGNAYGTAVVLVMLVTTLLMVLIML

SEQ ID NO: 355 - protein, 357 aa, Arabidopsis thaliana
MGIMEAERKTTGWAARDPSGILSPYTYTLRETGPEDVNIRIICCGICHTDLHQTKNDLGMSNYPMVPGHEVVGEVVEVGSDVSKFTVGDIVGVGCLVGCCGGCSPCERDLEQYCPKKIWSYNDVYINGQPTQGGFAKATVVHQKFVVKIPEGMAVEQAAPLLCAGVTVYSPLSHFGLKQPGLRGGILGLGGVGHMGVKIAKAMGHHVTVISSSNKKREEALQDLGADDYVIGSDQAKMSELADSLDYVIDTVPVHHALEPYLSLLKLDGKLILMGVINNPLQFLTPLLMLGRKVITGSFIGSMKETEEMLEFCKEKGLSSIIEVVKMDYVNTAFERLEKNDVRYRFVVDVEGSNLDA

SEQ ID NO: 356 - protein, 526 aa, Arabidopsis thaliana
MGHGGEGMSLEFTPTWVVAGVCTVIVAISLAVERLLHYFGTVLKKKKQKPLYEALQKVKEELMLLGFISLLLTVFQGLISKFCVKENVLMHMLPCSLDSRREAGASEHKNVTAKEHFQTFLPIVGTTRRLLAEHAAVQVGYCSEKGKVPLLSLEALHHLHIFIFVLAISHVTFCVLTVIFGSTRIHQWKKWEDSIADEKFDPETALRKRRVTHVHNHAFIKEHFLGIGKDSVILGWTQSFLKQFYDSVTKSDYVTLRLGFIMTHCKGNPKLNFHKYMMRALEDDFKQVVGISWYLWIFVVIFLLLNVNGWHTYFWIAFIPFALLLAVGTKLEHVIAQLAHEVAEKHVAIEGDLVVKPSDEHFWFSKPQIVLYLIHFILFQNAFEIAFFFWIWVTYGFDSCIMGQVRYIVPRLVIGVFIQVLCSYSTLPLYAIVSQMGSSFKKAIFEENVQVGLVGWAQKVKQKRDLKAAASNGDEGSSQAGPGPDSGSGSAPAAGPGAGFAGIQLSRVTRNNAGDTNNEITPDHNN

SEQ ID NO: 357 - protein, 192 aa, Arabidopsis thaliana
PTWVVAGVCTVIVAISLAVERLLHYFGTVLKKKKQKPLYEALQKVKEELMLLGFISLLLTVFQGLISKFCVKENVLMHMLPCSLDSRREAGASEHKNVTAKEHFQTFLPIVGTTRRLLAEHAAVQVGYCSEKGKVPLLSLEALHHLHIFIFVLAISHVTFCVLTVIFGSTRIHQWKKWEDSIADEKFDPETA

SEQ ID NO: 358 - protein, 174 aa, Arabidopsis thaliana
CTVIVAISLAVERLLHYFGTVLKKKKQKPLYEALQKVKEELMLLGFISLLLTVFQGLISKFCVKENVLMHMLPCSLDSRREAGASEHKNVTAKEHFQTFLPIVGTTRRLLAEHAAVQVGYCSEKGKVPLLSLEALHHLHIFIFVLAISHVTFCVLTVIFGSTRIHQWKKWEDSI

SEQ ID NO: 359 - protein, 347 aa, Arabidopsis thaliana
MSYEKELAAAKKAVTLAARLSQEVQKTLLQSQVWKKSDRSPVTAADYGSQAVVSLVLERELQPDKLSLVAEEETGDLRKNGSEAFLEDIAKLVKDTLASEESYTSSPLSTDDVLNAIDCGKSEGGCKGSHWVLDPIDGTRGFVRGEQYAVGLALLVEGKVVLGVMACPNLPLASAVCATDNSSQEDVGCLFFATTGSGTYVQSLKGNSLPQKVQVSSNENLDEAKFLESYHKPIPIHGTIAKKLGIKALPVRIDSQAKYAALSRGDAEIYLRFTLNGYRECIWDHAPGSIITTEAGGVVCDATGKSLDFSKGKYLAHKTGIIVTTKKLKPWILKAVRESIEEENLYF

SEQ ID NO: 360 - protein, 277 aa, Arabidopsis thaliana
MSNKVHVGSLEMEEGLSKTKWMVLEPSEKIKKIPKRLWNVGKEDPRRVIHALKVGLSLTLVSLLYLMEPLFKGIGSNAIWAVMTVVVVLEFSAGATLCKGLNRGLGTLIAGSLAFFIEFVANDSGKVLRAIFIGTAVFIIGAAATYIRFIPYIKKNYDYGVVIFLLTFNLITVSSYRVDSVINIAHDRFYTIAVGCGICLFMSLLVFPIWSGEDLHKTTVGKLQGLSRSIEACVDEYFEEKEKEKTDSKDRIYEGYQAVLDSKSTDETLVSLYYIFL

SEQ ID NO: 361 - protein, 324 aa, Arabidopsis thaliana
MSNKVHVGSLEMEEGLSKTKWMVLEPSEKIKKIPKRLWNVGKEDPRRVIHALKVGLSLTLVSLLYLMEPLFKGIGSNAIWAVMTVVVVLEFSAGATLCKGLNRGLGTLIAGSLAFFIEFVANDSGKVLRAIFIGTAVFIIGAAATYIRFIPYIKKNYDYGVVIFLLTFNLITVSSYRVDSVINIAHDRFYTIAVGCGICLFMSLLVFPIWSGEDLHKTTVGKLQGLSRSIEACVDEYFEEKEKEKTDSKDRIYEGYQAVLDSKSTDETLALYANWEPRHTLRCHRFPCQQYVKVGAVLRQFGYTVVALHGCLQTEIQVRLLITL

SEQ ID NO: 362 - protein, 525 aa, Glycine max
MELVLHFLNTTTIGVVSLIFLLCLFLYGPLKKVHGSSKEAPTVGGAWPIFGHLPLLIGSKSPHKALGALAEKHGPLFTIKLGAKKALVVSDWEMARECFTTNDVAVSARPKLLVAELMCYNNAMLLVAPYGPYWRELRKIIVTEILSSSRVEQLQDVRVSEVQNSIVELYDVWRSQKNESDYASVELKQWFAQPIFNMVLRMVVGKRFLSATATDEKAEKCVKAVDEFMRLAGVFTVGDAIPYLRWLDFGGYEKAMKETAKELDVMISEWLEEHRQKRALGEGVDGAQDFMNVMLSSLDGKTIDGIDADTLIKSTVLTIIQAGTEASISTIIWAMCLILKNPLILENKAELDIQVGKDRCICESDISNLVYLQAVVKETLRLYAPGPLSSPREFAEDCTLGGYHVKKGTRLITNIWKIHTDPNVWSDPFEFKPDRFLTTHKDIDVKGHHFQLLPFGSGRRVCPGISFGLQTVHLALASFLHSFEILNPSTEPLDMTEAFGVTNTKATPLEVLVKPCLSPSCYKSM

SEQ ID NO: 363 - protein, 141 aa, Glycine max
TTIGVVSLIFLLCLFLYGPLKKVHGSSKEAPTVGGAWPIFGHLPLLIGSKSPHKALGALAEKHGPLFTIKLGAKKALVVSDWEMARECFTTNDVAVSARPKLLVAELMCYNNAMLLVAPYGPYWRELRKIIVTEILSSSRV

SEQ ID NO: 364 - protein, 158 aa, Glycine max
NTTTIGVVSLIFLLCLFLYGPLKKVHGSSKEAPTVGGAWPIFGHLPLLIGSKSPHKALGALAEKHGPLFTIKLGAKKALVVSDWEMARECFTTNDVAVSARPKLLVAELMCYNNAMLLVAPYGPYWRELRKIIVTEILSSSRVEQLQDVRVSEVQNSI

SEQ ID NO: 365 - protein, 765 aa, Arabidopsis thaliana
MASHIVGYPRMGPKRELKFALESFWDGKSTAEDLQKVSADLRSSIWKQMSAAGTKFIPSNTFAHYDQVLDTTAMLGAVPPRYGYTGGEIGLDVYFSMARGNASVPAMEMTKWFDTNYHYIVPELGPEVNFSYASHKAVNEYKEAKALGVDTVPVLVGPVSYLLLSKAAKGVDKSFELLSLLPKILPIYKEVITELKAAGATWIQLDEPVLVMDLEGQKLQAFTGAYAELESTLSGLNVLVETYFADIPAEAYKTLTSLKGVTAFGFDLVRGTKTLDLVKAGFPEGKYLFAGVVDGRNIWANDFAASLSTLQALEGIVGKDKLVVSTSCSLLHTAVDLINETKLDDEIKSWLAFAAQKVVEVNALAKALAGQKDEALFSANAAALASRRSSPRVTNEGVQKAAAALKGSDHRRATNVSARLDAQQKKLNLPILPTTTIGSFPQTVELRRVRREYKAKKVSEEDYVKAIKEEIKKVVDLQEELDIDVLVHGEPERNDMVEYFGEQLSGFAFTANGWVQSYGSRCVKPPVIYGDVSRPKAMTVFWSAMAQSMTSRPMKGMLTGPVTILNWSFVRNDQPRHETCYQIALAIKDEVEDLEKGGIGVIQIDEAALREGLPLRKSEHAFYLDWAVHSFRITNCGVQDSTQIHTHMCYSHFNDIIHSIIDMDADVITIENSRSDEKLLSVFREGVKYGAGIGPGVYDIHSPRIPSSEEIADRVNKMLAVLEQNILWVNPDCGLKTRKYTEVKPALKNMVDAAKLIRSQLASAK

SEQ ID NO: 366 - protein, 413 aa, Spermophilus tridecemlineatus
MPSSISWGLLLLAGLSCLVAGSLAEDAQETGASKHDQEHPASHRIAPNLAEFALSLYRVLAHESNTTNIFFSPVSIAMALASLSLGTKADTHTQIMEGLGFNLTETAESDIHQGFQHLLQTLNKPNSQLQLTTGNGLFIDHNLKLLDKFLQDVKNLYHSEAFSTDFTNTEEAKKQINTYVEKGTQGKIVDLVKDLNRDSVLALVNYIFFKGKWEKPFEVDHTKEEDFHVDQVTTVRVPMMNRMGMFEVHYCSTLASWVLQMDYLGNATAIFLLPDEGKLQHLEDTITKEILAKFLKNRESSSVNLHFPKLNISGTMDLKPVLTRLGITNVFSYKADLSGITEDDPLRVSQALHKAVLTIDERGTEAAGATFLEMMPMSLPPEVKFDKPFLVVIIEHSTKSPLFVGKVVNPTLH

SEQ ID NO: 367 - protein, 413 aa, Spermophilus tridecemlineatus
MPSSISWGLLLLAGLSCLATGCLIEDSEKSDAPKHDQENSASHKIAPNLAEFAFSLYRVLAHESNTTNIFFSPVSIATALGSLSLGTKADTHTQIMEGVGFNLTEISEAEIHQGFQHLLQNLNKSNSQLQLTTGNGLFIDHNMKLLDKFLEDIKNLYHSEAFSTDFTNTEEAKKQINTYVEKGTQGKIVDLVKDLDRDSGLALVNYIFFKGTLEKPFKADHTMEQDFHVDEATTVRVPMMNRLGMFDLHYCPTLSSMVLKMKYLGDITAIFIMPKVGRMEYVEETLTKEFLDKLLKKDYTGKNTVHFPKLSISGTIDLKPVLTRLGITKVFSHEADLSGITEDAPLRVSQALHKAVLTIDEKGTEAERHTVKGPMALTLAPEVKFNRPFLVTLYDRSTKSPLFVGRVVNPTLH

SEQ ID NO: 368 - protein, 412 aa, Callosciurus caniceps
MPSSISWGLLLLAGLCCLAPGSLAGDAQETDASKDDHEHPACHKIAPNLAEFAFDLYRVLARQSNTTNIFFSPVSVATALAALSLGTKGDTHTQILEGLDFNLTEMAETDIHQGFQHLLQTLNRPNNQLQLTTGNGLFIDQSLKLADKFLEDVKNLYHSEAFSTNFTDSEEAKKQINGYVEKGTQGKIVDAVKTLDKNTVFALVNYIFFKGKWEKPFEVEHTTEGDFHVDQATTVKVPMMNRLGRFDLLYCTTLASWVLQMDYLGNATAIFLLPDEGKLQHLEDTITKEILSKFLKNRHTRTVNLYFPKLSITGTYDLRSVLSTLGITKVFSNEADLSGVTEEAPLKLSKGVHKAVLTIDERGTEAAGVTVLEAIPMSLPPDVRFDRPFLIIIYEHYTKSPLFVGKVVNPTQ

SEQ ID NO: 369 - protein, 137 aa, Mus musculus
GQAIKVTHKATGKVMVMKELIRCDEETQKTFLTEVKVMRSLDHPNVLKFIGVLYKDKKLNLLTEYIEGGTLKDFLRSVDPFPWQQKVRFAKGISSGMAYLHSMCIIHRDLNSHNCLIKLDKTVVVADFGLSRLIVEE

SEQ ID NO: 370 - protein, 125 aa, Mus musculus
TGKVMVMKELIRCDEETQKTFLTEVKVMRSLDHPNVLKFIGVLYKDKKLNLLTEYIEGGTLKDFLRSVDPFPWQQKVRFAKGISSGMAYLHSMCIIHRDLNSHNCLIKLDKTVVVADFGLSRLIV

SEQ ID NO: 371 - protein, 137 aa, Mus musculus; identical to SEQ ID NO: 369

SEQ ID NO: 372 - protein, 125 aa, Mus musculus; identical to SEQ ID NO: 370

SEQ ID NO: 373 - protein, 137 aa, Mus musculus; identical to SEQ ID NO: 369

SEQ ID NO: 374 - protein, 125 aa, Mus musculus; identical to SEQ ID NO: 370

SEQ ID NO: 375 - protein, 149 aa, Mus musculus
TKPYEAVKGKKFIVVCGNITVDSVTAFLRNFLHWKSGEINIEIVFLGETLPCLELETLLKCHTSCTNFVCGTALKFEDLKRVAVENSEACLILANHFCSDLHDEDNSNIMRVLSIKNYYPQTRVIIQILQSQNKVFLSKIPNWDWSAGD

SEQ ID NO: 376 - protein, 69 aa, Mus musculus
VKGKKFIVVCGNITVDSVTAFLRNFLHWKSGEINIEIVFLGETLPCLELETLLKCHTSCTNFVCGTALK

SEQ ID NO: 377 - protein, 867 aa, Mus musculus
MALVFSALLLLGLCGKISSEGQPAFHNTPGAMNYELPTTKYETQDTFNAGIVGPLYKMVHIFLSVVQPNDFPLDLIKKLIQNKKFDISVDSKEPEIIVLALKIALYEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQLPSVDRELNTVTEVDKTDLESLVKRGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDVETVPMKNLEIGSNGYHKDHLYGVHNPVMTSPSRY

SEQ ID NO: 378 - protein, 187 aa, Mus musculus
ASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDVETVPMK

SEQ ID NO: 379 - protein, 97 aa, Mus musculus
VKKILASLDSVQHFLTNNVSLIVIGETKKFGKTILGYFEHYLHWVFYAITEKMTSCKPMATAMDSAVNGILCGYVADPLNLFWFGIGKATVLLLPAV

SEQ ID NO: 380 - protein, 858 aa, Mus musculus
MALVFSALLLLGLCGKISSEGQPAFHNTPGAMNYELPTTKYETQDTFNAGIVGPLYKMVHIFLSVVQPNDFPLDLIKKLIQNKKFDISVDSKEIALYEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQLPSVDRELNTVTEVDKTDLESLVKRGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDVETVPMKNLEIGSNGYHKDHLYGVHNPVMTSPSRY

SEQ ID NO: 381 - protein, 187 aa, Mus musculus; identical to SEQ ID NO: 378

SEQ ID NO: 382 - protein, 97 aa, Mus musculus; identical to SEQ ID NO: 379

SEQ ID NO: 383 - protein, 834 aa, Mus musculus
MALVFSALLLLGLCGKISSEGQPAFHNTPGAMNYELPTTKYETQDTFNAGIVGPLYKMVHIFLSVVQPNDFPLDLIKKLIQNKKFDISVDSKEIALYEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQLPSVDRELNTVTEVDKTDLESLVKRGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDSSVSGMWHFTL

SEQ ID NO: 384 - protein, 174 aa, Mus musculus
EGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDSSVSGM

SEQ ID NO: 385 - protein, 97 aa, Mus musculus; identical to SEQ ID NO: 379

SEQ ID NO: 386 - protein, 804 aa, Mus musculus
MALVFSALLLLGLCGKISSEGQPAFHNTPGAMNYELPTTKYETQDTFNAGIVGPLYKMVHIFLSVVQPNDFPLDLIKKLIQNKKFDISVDSKEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDSSVSGMWHFTL

SEQ ID NO: 387 - protein, 174 aa, Mus musculus; identical to SEQ ID NO: 384

SEQ ID NO: 388 - protein, 97 aa, Mus musculus; identical to SEQ ID NO: 379

SEQ ID NO: 389 - protein, 809 aa, Mus musculus
MALVFSALLLLGLCGKISSEGQPAFHNTPGAMNYELPTTKYETQDTFNAGIVGPLYKMVHIFLSVVQPNDFPLDLIKKLIQNKKFDISVDSKEIALYEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDSSVSGMWHFTL

SEQ ID NO: 390 - protein, 174 aa, Mus musculus; identical to SEQ ID NO: 384

SEQ ID NO: 391 - protein, 97 aa, Mus musculus; identical to SEQ ID NO: 379

SEQ ID NO: 392 - protein, 823 aa, Mus musculus
MALVFSALLLLGLCGKISSEGQPAFHNTPGAMNYELPTTKYETQDTFNAGIVGPLYKMVHIFLSVVQPNDFPLDLIKKLIQNKKFDISVDSKEIALYEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQLPSVDRELNTVTEVDKTDLESLVKRGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDE

SEQ ID NO: 393 - protein, 160 aa, Mus musculus
LLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDE

SEQ ID NO: 394 - protein, 97 aa, Mus musculus; identical to SEQ ID NO: 379

SEQ ID NO: 395 - protein, 312 aa, Anas platyrhynchos
MLPAAGLLWWVGALGALYAAVRGALGLLGALRVWGIGAGRAALGPGLGAWAVVTGATDGIGKAYAKELAKRGMKVALISRSKEKLDQVAGEITEQYGVETKVIVADFGEREDIYDRIRAGLEGLEIGVLVNNVGISYSYPEYFIDVPDLDKTIDKMININIMSVCKMTRLVLPGMLERSKGVILNISSAAGMYPTPLLTLYSASKAFVDYFSRGLHAEYKSKGIIVQSVMPYYVATKMSKISKPSFDKPTPETYVRAAIGTVGLQSQTNGCLPHAFMGWVFSILPTSTVMNLLMKTNKQIRARFLKKKMKEK

SEQ ID NO: 396 - protein, 543 aa, Ambystoma tigrinum
MTKSNGEDPRAGSRMERFQQGVRQRTLLAKKKVQNITKDDVKGFLKRNGFVLFTVIAVVVGSILGFSVRSYHMTFRELKYFSFPGELLMRMLQMLVLPLIVSSLVTGMAALDSKASGKMGLRAVVYYMTTTVIAVFIGIVIVIIVHPGKGTKEHMHREGKIEPVTAADAFLDLIRNMFPPNMVEACFKQFKTSYEKKIFKVTMPANETAVMTSVLNNVSEAMETLTKMREEMIPVPGAVNGVNALGLVVFSMCFGLVIGNMKEQGKALKDFFDSLNEAIMRLVAVIMWYAPIGILFLIAGKIAEMEDMGVVGGQLGMYTVTVIIGLLIHAVIVLPLLYFAVTRKNPWVFIGGILQALITALGTSSSSATLPITFKCLEENNKVDKRVTRFVLPVGATINMDGTALYEALAAIFIAQVNNYDLNFGQILTISITATAASIGAAGIPQAGLVTMVIVLTSVGLPTDDITLIIAVDWFLDRLRTTTNVLGDSLGAGIVEHLSRHELQSGDAEMGNSVIEENEMKKPYQLVSQENELEKPIDSETKM

SEQ ID NO: 397 - protein, 199 aa, Danio rerio
LLDKVQAYSTAGGKVWLSVLFIFRILVLGTAVESAWGDEQSAFKCNTQQPGCENVCYDKSFPISHVRFWVLQIIFVSTPTLLYLAHVFYLMRKEEKLNRKEEELKAVQNDGGDVELHLKKIELKKFKHGLEEHGKVKMKGSLLRTYIFSIIFKSICEVVFLVIQWYLYGFSLSAVYTCERTPCPHRVDCFLSRPTEKTI

SEQ ID NO: 398 - protein, 132 aa, Danio rerio
VSTPTLLYLAHVFYLMRKEEKLNRKEEELKAVQNDGGDVELHLKKIELKKFKHGLEEHGKVKMKGSLLRTYIFSIIFKSICEVVFLVIQWYLYGFSLSAVYTCERTPCPHRVDCFLSRPTEKTIFIIFMLVV

SEQ ID NO: 399 - protein, 132 aa, Danio rerio; identical to SEQ ID NO: 398

SEQ ID NO: 400 - protein, 96 aa, Danio rerio
LKAVQNDGGDVELHLKKIELKKFKHGLEEHGKVKMKGSLLRTYIFSIIFKSICEVVFLVIQWYLYGFSLSAVYTCERTPCPHRVDCFLSRPTEKTI

SEQ ID NO: 401 - protein, 519 aa, Rana dybowskii
MKLCFFLLIFIRSFLLFKIKLVRTSEKKWRMGSRSHGDVKHPKSLPSLPVIGSLLHLGKKLPPHILFCNLQKKYGSLYSFMMGSHYVVVVNNHEDAREVLLKKGKTFGGRPRTVTTDILTRDGKDIAFADYSPTWKFHRKMVHSALCMFGEGTVAIEQIISREAASLCQTLTSFQRIPLDMAPELIRAVTNVVCSLCFNTRYKRGDAEFETMLKYSKGIVDTVAKDSLVDIFPWLQIFPNKDLDILRQSVAARDQLLQKKINEHKDAFCGETVKDLVDALLKAKLNMENNNSNVSQDVGLTEDHILMTVGDIFGAGVETTSTVLKWAVAYLLHYPEVQKKIQEELDVKVGFGRYPLLSDRKILHYTEAAISEVLRIRPVSPLLIPHVALKESSIGEYTIPKEARVVINLWSLHHDEKEWVNPHLFSPDRFLDENGNRVYSPSPSFLPFGAGIRVCLGEALAKMEVFLFLSWILQRFTLEVPEGDPLPDLEGKFGVVIQVKPFKVIAKLREVWKNIEIVT

SEQ ID NO: 402 - protein, 136 aa, Xenopus laevis
AADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDL

SEQ ID NO: 403 - protein, 195 aa, Xenopus laevis
LYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPH

SEQ ID NO: 404 - protein, 105 aa, Pyrococcus horikoshii
VIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNP

SEQ ID NO: 405 - protein, 103 aa, Pyrococcus horikoshii
WFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIV

SEQ ID NO: 406 - protein, 394 aa, Pyrococcus horikoshii
MLLEAPVYKEIFGAVTIHEVQKVIKMDTETEEVPIYTISNIPREKIYDLLGKMAVIVPMKNEKLHLVDGVLKAIPHKCPIIIVSNSKREGPNRYKLEVDLIRHFYNLTHSKIIMIHQKDPGLAKAFKEVGYTDILDENGMIRSGKGEGMLVGLLLAKAIGAEYVGFVDADNYIPGAVNEYVKDYAAGFLMSESEYTMVRLHWRHKPKVTKGTLYFKKWGRVSEITNHYLNLLVSEHTAFETTIMVTGNAGEHAMTMKLAEILPFSTGYSIEPYEIVYILERFGKWENVEEFKDVFDQGIEIFQIETLNPHFHEDKGKEHVKEMLLLSLATIYHSKLATDNLRKRILKDLRDHGILGENEEPPKPLVMRPIKEIPIKEWMDIVEGNSETLLRFEL

SEQ ID NO: 407 - protein, 417 aa, Schizosaccharomyces pombe
MALLPFFDLTNFESDASEELGWLKYVGRVQTRVFPQHFKDNLEKVRKISETIDVIVDTTAELGPEACVNLLNAGALAILVNEEMLNELADISPNRLVLKTDTTDIGKIEKLSQVAGSIQWIGSAENYPPDFFERASKIIHKAVMPEGGGRTLYLEFPEQPSMEVLKSFSVHSVVPVLSSSFLTVKPAEEPKKLSLADLILISANTDREDGLFSTLVVNELGIALGLVYSSKESVAESLKTGTGVYQSRKRGLWYKGASSGAVQHLIHIDVDCDEDCLRFVVYQTGKGFCHLDTLHCFGQASGLCQLEKTLIDRKNNAPEGSYTARLFSDPKLLRAKIMEEAEELCDATTKENVIWEMADLMYFAITRCVGSGVSLNDISRHLDLKHRKVTRRKGDAKVAWQEKLKDKGGVANTSYTA

SEQ ID NO: 408 - protein, 1213 aa, Schizosaccharomyces pombe
MSSKLVDAINEVAVSNKDKIELDGIKDDSFDGHLSITEATYDVDTFLKPSPALSKDWIRKLQKKWDREITYKGLYEYPETLARTQIRFQRHGLEGKIMGYKEVPELIEDLNSKNSSSFLRKPSSKNEFVRGSTSNIPFLADDSDVDAIAGEPSVKMALYGEDGLLQVPPGFSRGLSMTATSTTDNLNDEFDPEKWDTKKVKSSNRNFVTIHELNEHLKNVNSKHSEIDDLLPDKRSIVSLPPSTLNLHKQPDYAHVVDSSAPIENFQQLVPEMALDFPFELDNFQKEAIYHLEMGDSVFVAAHTSAGKTVVAEYAIALAQKHMTKAIYTSPIKALSNQKFRDFKHKFEDVGILTGDVQVNPEGSCLLMTTEILRSMLYRGADLIRDVEFVIFDEVHYVNDLERGVVWEEVIIMLPPHVTLILLSATVPNTKEFASWVGRTKKKNIYVISTLKRPVPLEHYLWVKQNMFKIVDQHGRFLMDGYKSANDALKKPDKPVIAKDNKNSARGRGAARGRGVQTNMMRGRGSAKSVERRDANTWVHLIGHLHKQNLLPVIVFVFSKKRCEEYVDTLTNRDLNNHQEKSEVHVVIEKAVARLKKEDRLLPQIGRMREMLSRGLAVHHGGLLPIIKEIVEILFQRGLVKVLFATETFAMGVNMPAKSVVFSGTQKHDGRNFRDLLPGEYTQCSGRAGRRGLDVTGTVIILSRSELPDTASLRHMIMGPSSKLISQFRLTYNMILNLLRVETLRIEDMIKRSFSENVNQTLVPQHEEKIKSFEEKLSALKKEMSDVDLKEIKSCLLSSESFKEYTKKMHFRAITTANGKRIFKDGRVIVFQQLDFTRTVGVLLGTSIRTNASDCTLEVAYLNPQNNLKRPSDLLAFADAFNDVYDNAIFDESNQFKYGLINLSGIERVCNTILRIDSGGIRDRRGGAFRKLSEQFASIKKFSDLLFEEVNWSKVRDFEFCEAFEKRNFLQNKLSGNPIISTPNFLTHFALAYQEYELESNIDNLSSYISDQNLELLPDYEQRIKVLQELGYIDAERTVLLKGRVACEINSTSELVLTELILENSLADFSCEETIALLSAFVFDEKTEVEPTISPHLQKGKEMILSVAEKVNQIQEHYQVLYFNEGNDFESQPRFGLMEVCYEWARGMSFNRITDLTDVLEGSIVRTIIRLDEVLRECRGAARVVGDSSMYTKMEECQNLIRRNIVFCPSLYM

SEQ ID NO: 409 - protein, 126 aa, Schizosaccharomyces pombe
LLMTTEILRSMLYRGADLIRDVEFVIFDEVHYVNDLERGVVWEEVIIMLPPHVTLILLSATVPNTKEFASWVGRTKKKNIYVISTLKRPVPLEHYLWVKQNMFKIVDQHGRFLMDGYKSANDALKK

SEQ ID NO: 410 - protein, 82 aa, Schizosaccharomyces pombe
EEVIIMLPPHVTLILLSATVPNTKEFASWVGRTKKKNIYVISTLKRPVPLEHYLWVKQNMFKIVDQHGRFLMDGYKSANDAL

SEQ ID NO: 411 - protein, 533 aa, Schizosaccharomyces pombe
MTIDWRQIAAKYCAHRDGSIPEPFKIKTLPKDTVLNVTKIPSECGLLTPKEIELTEKYDATALAEMIKDRKVTSVELVTAFCKRAAIAQQLVNCVNELFYEEALARAAELDEYYAKTGSLVGPLHGVPVSVKEHISIKNHTATASFLAKANIIAEKDSDLVATVRKAGAVFYCRTPQPQAIMHLETSSNLTGVTVNPFNRKLTPGGSSGGEGALLGIKASVLGIGSDIGGSIRSPAANNGLFGLRPSTLRLSRKGCQGAVSGQETILGVVGPLGRSVRDMNLFMKACIDSQPWLDDASLLPMPWRSVAPPKTLKVGIMRSDNVVNPQPPVARAMQMAIDQLSKNPDFDLVDVEPLDHKYSWDLISEMYWLDGGKVYYDLFNKVGEPILPLTEWIMHQPNVKPHDITAVWKLTAARDEYRNRYLKHLQAYGVDVLLTPVGPSPAPKLGEAKYWTYTSVWNLLDLPAVVFPVTTVDPKLDVKDESYIPMNEQDAANYETYSPEDYLDAPVSLQLVGKRWQDEELLAALDKIVSML

SEQ ID NO: 412 - protein, 440 aa, Schizosaccharomyces pombe
MTTDVKAKNPASIFSHETLLHVLNDLSAHDLAALERVSRSWNSIVRRSSVWHNLYLSEFGTKHLRRHGRIEKKRRNWKGLFRRQSNWKDGRCKKVESMLPQLLNSEKSVGEDRLGLTLTHQNNIYFCNDVQISKWSSVGNSLKCQAISSFRDETVKSGPAVMCLDNASLYIGLKDGNLLHVTVHETGFGNIENLATFSTKFVALSSHKNYICGLTNDNNLYILQHSHQAGTKLKVLGKYHVSSIEKQVAIHFQQSKEGYEVVHVVFNDYVLSGGWTVSLQEFVFNEYCVKSSRLALHDNKDIEYSQQPASAIFMYGSYILTSHPDNSLILQRLYSTNNELRIKFLGRLLGHVCGVQISKLFSCGRIVSVSKNCADICVWDLHDTNYQSIVSPLMLTCTNIHNKPVSDYEKECKVQDIGLYEDTILITLSDGRILKFLFNI

SEQ ID NO: 413 - protein, 676 aa, Schizosaccharomyces pombe
MKVQSKAISKPKEHESAIYRNANFPDHLVETYSDDVHTLFDVFRHSVKQFGNKKAMGYRNLVKEHVETKMVTKVVDGEKKEVPKSWSYFELSDYNYLSFNDIYDKALRYAGALRKLGLNKGDKFELYAPTSAFWLLTAEACLSQSMTIVTAYDTLGEEGLLHSLRESGVRGMYTEGHLLKTLVNPLKEIESLEVIIYRNDAKEEDIKTIQEIRPNLKLIKFADFEKMSPPVEPDPPSPEEICCIMYTSGSTGLPKGVILSHKNMVAIVTAIVKHVPEVTSKDYLLAYLPLAHILEFAFENICLAWGGTIGYANVRTLVDTNCRNCKGDINTFRPTIMVGVPAVWEMVRKGIMSKLNAASAVKRSVFWTAYYTKAKLMRHNLPGSCVLDTAVFNKIRSMGTGGRLRYTLSGGSALSPDTKRFLSIVLCPMLIGYGLTEISAAAMVQNPACFNLDDSAGSLLPCTEMKLVDCEEGNYNSHGHPPRGEIWLRGPSLTRGYLNRDKENKESFTPDGWFRTGDVGELTPEGLLRIIDRKKNLVKTQNGEYIALEKLESRYRTSSLVSNICVYADQTKVKPLAIIVPNEPVVRKLATEQAGLSPDASWEEVCHNKKVRQLVYDDLIRIGRSHHFANIELIQNVVLVPIEFTPENGLVTAAQKLQRRKILDRFKKEIDAAYAE

SEQ ID NO: 414 - protein, 38 aa, Schizosaccharomyces pombe
ALCERLKEQSWTIVFKTLIVFHVMLKEGAPNTTIVALS

SEQ ID NO: 415 - protein, 25 aa, Schizosaccharomyces pombe
LCERLKEQSWTIVFKTLIVFHVMLK

SEQ ID NO: 416 - protein, 460 aa, Drosophila melanogaster
MGDWAKKSEDQEVSKLVDKLNLDSKSGEETDFDVADPAETSLLIKILGKGLVNTKLSLDLQQKNPNSPLHSVKTFEALHLKASLLKGIYAMGFNTPSKIQETALPTLLADPPQNMIAQSQSGTGKTAAFVLAMLSRVNVCLNHPQVLCLSPTYELAIQTGEVAARMGQFCREIKLRFAVRGEEVDRSKKIEEHILIGTPGKLLDWGIKFRLFDMKKISVFVLDEADVMIATQGHHDQCIRIHKMLNPHCQMLFFSATYGKEVMDFARLIVADPTIIRLMREEESLENIKQYYVKCKNEEGKYNAIQNIYGCISVGQAIIFCHTKRTAAWLAAKMTSDGHSVAVLTGDLTVVQRLDVLDRFRSGLEKVLITTNILSRGIDIEQLQVVVNFDLPVDLDGMADCETYLHRIGRTGRFGKSGIAINLITDEKTMKVCSDIEKHFNKKIEVLNTDSADDIEKIGT

SEQ ID NO: 417 - protein, 412 aa, Aplysia californica
MNKLSINDVDVRDKRVLIRVDFNVPLKNGQISNNQRIAAALPTIKLALEKGAKSVVLMSHLGRPDGRPIHAASMKPVVAELENLLGKKIMFLEDCVGSKVEAACANPEPGSVILLENLRFHVEKEGKGKDAQGNKAKADDAAVAAFRASLSKLGDVYVNDAFGTAHRAHSSMVGVDLPVKACGLLMKKELDYFAKALENPARPFLAILGGAKVADKIQLIENLMDKVNEMIIGGGMAFTFLKVLNNMDIGGSLFDEGAKIVGRLVDKAKEKGVKLHLPSDFITGDKFADVAKSATASVASGIPEGWMGLDVGTKTNEVFQKVIEGAKTIVWNGPPGVFEFENFSTGSKQMMDSVVRATEAGTITIIGGCDTATCAKNSNATEKVSHVSTGSGTSLELLEGKILPGVAALSQP

SEQ ID NO: 418 - protein, 378 aa, Caenorhabditis elegans
MNRIERILEGFDPVSNGLDEDFVLTKLTGMKGCGCKVPRNVLLQLLQTFKTDLVINNDEVDIGLDSCVIPLRHPGLRLVQTTDFFYPLIDDPYIMGRVTCANVLSDLYAMGVSECDNMLMLLAVAIDLNEKQRDIVVPLFIQGFKDAADEAGTKIRGGQTVRCPWLLLGGVATSVAHESEIIKVDQAVPGDVLILTKPIGGQVAVNSYEWIKKKNGKIEELNLEIPKIEKAFKQVCEQMSRLNRNAAKLLHKYDAHSSTDVTGFGLLGHAENLARVQKQPMEFIIEKLPIIEYMDEIADKMIAKGGEGFKLYQGTSAETSGGLLIAMSEENAKKYIAELSSLDNAPAWIIGKVTAKTTDSSIARILPDAVRISVPSHI

SEQ ID NO: 419 - protein, 498 aa, Solanum tuberosum
MKKVTVGAAVVGAAAVCAVAALIVNHRMRKSSKWGRAMAILREFEEKCKTQDAKLKQVADAMTVEMHAGLASEGGQSSRCLSPMSIISQLVMKLGVFYALDLGGTNFRVLRVQLGGKDGGIIHQEFAEASIPPSLMVGTSDALFDYIAAELAKFVAAEEEKFHQPPGKQRELGFHLLIPSNADFNNSGTIMRWTKGFSIDDAVGQDVVGELTKAMKEKVLDMRVSALVNDTVGTLAGGKYTQKDVAVAVILGTGTNAAYVERVQAIPKWHGPVPKSGEMVINMEWGNFRSSHLPLTEYDHALDNESLNPAEQIFEKMTSGMYLGEILRRVLTRVAEEVLAFLAMRSLQSLKDSFVLRTPDMSAMHHDTSPDLKVVGEKLKDILEISNTSLKTRKLVLSLCNIVATRGARLDAAGVLGILKKMGRDTPKQGGSERTVIAMDGGLYEHYTEYRMCLENSLKDLLGEELATSIVFVHSNDGSGIGAALLRASHSMYLEDQA

SEQ ID NO: 420 - protein, 142 aa, Arabidopsis thaliana
DEKTLTGEAFPVPKQRDSTVWAGTINLNGYICVKTTSLAGDCVVAKMAKLVEEAQSSKTKSQRLIDKCSQYYTPAIILVSACVAIVPVIMKVHNLKHWFHLALVVLVSGCPCGLILSTPVATFCALTKAATSGLLIKSADYL

SEQ ID NO: 421 - protein, 89 aa, Arabidopsis thaliana
KCSQYYTPAIILVSACVAIVPVIMKVHNLKHWFHLALVVLVSGCPCGLILSTPVATFCALTKAATSGLLIKSADYLDTLSKIKIVAFDK

SEQ ID NO: 422 - protein, 335 aa, Arabidopsis thaliana
MVIVLQPASFDSNLYVNPKCKPRPVLIPVIDLTDSDAKTQIVKACEEFGFFKVINHGVRPDLLTQLEQEAINFFALHHSLKDKAGPPDPFGYGTKRIGPNGDLGWLEYILLNANLCLESHKTTAIFRHTPAIFREAVEEYIKEMKRMSSKFLEMVEEELKIEPKEKLSRLVKVKESDSCLRMNHYPEKEETPVKEEIGFGEHTDPQLISLLRSNDTEGLQICVKDGTWVDVTPDHSSFFVLVGDTLQVMTNGRFKSVKHRVVTNTKRSRISMIYFAGPPLSEKIAPLSCLVPKQDDCLYNEFTWSQYKLSAYKTKLGDYRLGLFEKRPPFSLSNV

SEQ ID NO: 423 - protein, 341 aa, Arabidopsis thaliana
MASCVTGTEAAIRAAACRDGEEASHLKIVAVFAIFLTSVFGVWGPVLLAKYFHGKPLYDKAILVIKCFAAGVILSTSLVHVLPEAFESLADCQVSSRHPWKDFPFAGLVTMIGAITALLVDLTASEHMGHGGGGGGDGGMEYMPVGKAVGGLEMKEGKCGADLEIQENSEEEIVKMKQRLVSQVLEIGIIFHSVIIGVTMGMSQNKCTIRPLIAALSFHQIFEGLGLGGCIAQAGFKAGTVVYMCLMFAVTTPLGIVLGMVIFAATGYDDQNPNALIMEGLLGSFSSGILIYMALVDLIALDFFHNKMLTTCGESGSRLKKLCFVALVLGSASMSLLALWA

SEQ ID NO: 424 - protein, 459 aa, Arabidopsis thaliana
MAPPTKRTRVEMAESSNKRMKPSETVPEDVLELMMSTYLPVQSLLTTRVLSKRFRETEVRSLDLDFSGIYSRRRRKVEVVGIIEKVFNQHKGSEIHRFVLLLNHIGVEDKIISWTNTCFDKNIKELVLDFSKSRKVMAIPIDFSAVESLQVLKLRWCKFEIPDSSPKGLKLLKTLSLMRTQVMVKTIDAIFNNCIHLESLELIECRMDGILSIRAQNHKKFKSLVVSFMPDLRHIRLDAPTLENYKYDGYVICVNILITNALKEANLYYTRIRRLYHQKSDLVDTLRFYTRLTVLATTTIFLEALTKRYVGEGRLENPPFKFENLTEFKISFITPTFCTLFDIAEFLKECPKLKQVVIDIQNFTFEPQMYFWEIHHKAQIQNTSNNNYLLKCLTDVKIIGYKGHWHELDIVEFFVKNAPSLKRLELQMPKNAKNDAHTPDVARIKLIKTIFSGVKVTEV

SEQ ID NO: 425 - protein, 162 aa, Arabidopsis thaliana
MSTYLPVQSLLTTRVLSKRFRETEVRSLDLDFSGIYSRRRRKVEVVGIIEKVFNQHKGSEIHRFVLLLNHIGVEDKIISWTNTCFDKNIKELVLDFSKSRKVMAIPIDFSAVESLQVLKLRWCKFEIPDSSPKGLKLLKTLSLMRTQVMVKTIDAIFNNCIH

SEQ ID NO: 426 - protein, 104 aa, Arabidopsis thaliana
VFNQHKGSEIHRFVLLLNHIGVEDKIISWTNTCFDKNIKELVLDFSKSRKVMAIPIDFSAVESLQVLKLRWCKFEIPDSSPKGLKLLKTLSLMRTQVMVKTIDA

SEQ ID NO: 427 - protein, 1015 aa, Arabidopsis thaliana
MESYLNSNFDVKAKHSSEEVLEKWRNLCSVVKNPKRRFRFTANLSKRYEAAAMRRTNQEKLRIAVLVSKAAFQFISGVSPSDYKVPEEVKAAGFDICADELGSIVEGHDVKKLKFHGGVDGLSGKLKACPNAGLSTGEPEQLSKRQELFGINKFAESELRSFWVFVWEALQDMTLMILGVCAFVSLIVGIATEGWPQGSHDGLGIVASILLVVFVTATSDYRQSLQFRDLDKEKKKITVQVTRNGFRQKMSIYDLLPGDVVHLAIGDQVPADGLFLSGFSVVIDESSLTGESEPVMVTAQNPFLLSGTKVQDGSCKMLVTTVGMRTQWGKLMATLSEGGDDETPLQVKLNGVATIIGKIGLSFAIVTFAVLVQGMFMRKLSLGPHWWWSGDDALELLEYFAIAVTIVVVAVPEGLPLAVTLSLAFAMKKMMNDKALVRHLAACETMGSATTICSDKTGTLTTNHMTVVKSCICMNVQDVASKSSSLQSDIPEAALKLLLQLIFNNTGGEVVVNERGKTEILGTPTETAILELGLSLGGKFQEERQSNKVIKVEPFNSTKKRMGVVIELPEGGRIRAHTKGASEIVLAACDKVINSSGEVVPLDDESIKFLNVTIDEFANEALRTLCLAYMDIESGFSADEGIPEKGFTCIGIVGIKDPVRPGVRESVELCRRAGIMVRMVTGDNINTAKAIARECGILTDDGIAIEGPVFREKNQEEMLELIPKIQVMARSSPMDKHTLVKQLRTTFDEVVAVTGDGTNDAPALHEADIGLAMGIAGTEVAKEIADVIILDDNFSTIVTVAKWGRSVYINIQKFVQFQLTVNVVALIVNFSSACLTGSAPLTAVQLLWVNMIMDTLGALALATEPPNNELMKRMPVGRRGNFITNAMWRNILGQAVYQFIIIWILQAKGKSMFGLVGSDSTLVLNTLIFNCFVFCQVFNEVSSREMEEIDVFKGILDNYVFVVVIGATVFFQIIIIEFLGTFASTTPLTIVQWFFSIFVGFLGMPIAAGLKKIPV

SEQ ID NO: 428 - protein, 206 aa, Arabidopsis thaliana
MANDVTKDPTPKSDIVEDIYLWRRKKLAFSTLLVSTSTWILLSFYGFTTITIVSWIGIAVVSMIFLWGSLLRLLSKVEPELSGLEVSEEFVVETVRSCRMLMEEMVRWMFRVGAESEWFVFARTVLGFWILSRIGNLLDFHTCLFIGLVMGLTVPKLWEEYGDQIQKHLGSLKDKSKGAYNTTHEKILEMKNKLHHGTEEKVKKSE

SEQ ID NO: 429 - protein, 717 aa, Prunus avium
MATNSIKQNGHKNGSVELPELCIKKDPLNWGVAAETLKGSHLDEVKRMVAEYRKPVVKLGGESLTISQVAAIATHDSGVKVELSESARAGVKASSDWVMDSMSKGTDSYGVTTGFGATSHRRTKQGAALQKELIRFLNAGVFGSTKESGHTLPHQATRAAMLVRINTLLQGYSGIRFEILEVITKFLNNNVTPCLPLRGTITASGDLVPLSYIAGMLTGRPNSKAVGPDGQTLSAAEAFEFVGINSGFFELQPKEGLALVNGTAVGSGLASTVLFDTNILALLSEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREIDSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLRNTVKNTVSQVAKRTLTTGVNGELHPSRFCEKDLLKVVDREYVFAYIDDPCSATYPLMQKLRQVLVEHALTNGENEKNASTSIFQKIVAFEEELKVLLPKEVDSARAALDSGSAGVPNRITECRSYPLYKFVREELGAEYLTGEKVRSPGEECDKVFTAICEGKIIDPILDCLEGWNGAPLPIC

SEQ ID NO: 430 - protein, 356 aa, Eucalyptus globulus
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 431 - protein, 213 aa, Arabidopsis thaliana
MASFATHLVVVVTMLFVAMASAEMLQDVCVADLSNAVKVNGYTCKDSTQITPEDFYFKGLANIAATNTSTGSVVTGANVEKLPGLNTLGLSMSRIDYAPNGLNPPHVHPRASEIIFVLEGQLYVGFVTTAGKLIAKNLNKGDVFTFPKGLIHFQKNIANSPASVLAAFDSQLPGTQSLVASLFGALPDDILAKSFQLKHKQVKKIKLRYAPKK

SEQ ID NO: 432 - protein, 408 aa, Arabidopsis thaliana
MRGGSLWQLGQSITRRLAQSDKKVVSRRYFASEADLKKTALYDFHVAHGGKMVPFAGWSMPIQYKDSIMDSTVNCRENGSLFDVAHMCGLSLKGKDCVPFLETLVVADVAGLAPGTGSLTVFTNEKGGAIDDSVITKVTDEHIYLVVNAGCRDKDLAHIEEHMKAFKSKGGDVSWHIHDERSLLALQGPLAAPVLQHLTKEDLSKLYFGNFQILDINGSTCFLTRTGYTGEDGFEISVPDEHAVDLAKAILEKSEGKVRLTGLGARDSLRLEAGLCLYGNDMEQHISPVEAGLTWAIGKRRRAEGGFLGADVILQQLKDGPTIRRVGFFSSGPPARSHSEVHDESGNKIGEITSGGFSPNLKKNIAMGYVKSGQHKTGTKVKILVRGKPYEGSITKMPFVATKYYKPT

SEQ ID NO: 433 - protein, 121 aa, Arabidopsis thaliana
IGVLVVNCSLFNPTPSLSAMIVNKYKLRGNIKSFNLGGMGCSAGVIAVDLASDMLQIHRNTFALVVSTENITQNWYFGNKKAMLIPNCLFRVGGSAVLLSNKPLDRKRSKYKLVHTVRTHK

SEQ ID NO: 434 - protein, 137 aa, Arabidopsis thaliana
AGVIAVDLASDMLQIHRNTFALVVSTENITQNWYFGNKKAMLIPNCLFRVGGSAVLLSNKPLDRKRSKYKLVHTVRTHKGSDENAFNCVYQEQDECLKTGVSLSKDLMAIAGEALKTNITSLGPLVLPISEQILFFA

SEQ ID NO: 435 - protein, 502 aa, Arabidopsis thaliana
MTILLCFFLVSLLTIVSSIFLKQNKTSKFNLPPSPSSLPIIGNLHHLAGLPHRCFHKLSIKYGPLVFLRLGSVPVVVISSSEAAEAVLKTNDLECCSRPKTVGSGKLSYGFKDITFAPYGEYWREVRKLAVIELFSSKKVQSFRYIREEEVDFVVKKVSESALKQSPVDLSKTFFSLTASIICRVALGQNFNESGFVIDQDRIEELVTESAEALGTFTFSDFFPGGLGRFVDWLFQRHKKINKVFKELDAFYQHVIDDHLKPEGRKNQDIVTLILDMIDKQEDSDSFKLNMDNLKAIVMDVFLAGIDTSAVTMIWAMTELIRNPRVMKKAQESIRTTLGLKKERITEEDLGKVEYLNHILKETFRLHPALPFVVPRETMSHIKIQGYDIPPKTQIQLNVWTIGRDPKRWNDPEEFNPERFANSSVDFRGQHFDLLPFGSGRRICPGMPMAIASVELALMNLLYYFDWSMPDGTKGEDIDMEEAGNISIVKKIPLQLVPVQRY

SEQ ID NO: 436 - protein, 82 aa, Aquifex aeolicus
LKDPTAHAEMLAIKEACRRLNTKYLEGCELYVTLEPCIMCSYALVLSRIEKVIFSALDKKHGGVVSVFNILDEPTLNHRVKW

SEQ ID NO: 437 - protein, 546 aa, Aquifex aeolicus
MEKIKYLKSIQISQRSVLDLKLLAVGAFTPLDRFMGEEDYRNVVESMRLKSGTLFPIPITLPMEKEIAKDLKEGEWIVLRDPKNVPLAIMRVEEVYKWNLEYEAKNVLGTTDPRHPLVAEMHTWGEYYISGELKVIQLPKYYDFPEYRKTPKQVREEIKSLGLDKIVAFQTRNPMHRVHEELTKRAMEKVGGGLLLHPVVGLTKPGDVDVYTRMRIYKVLYEKYYDKKKTILAFLPLAMRMAGPREALWHGIIRRNYGATHFIVGRDHASPGKDSKGKPFYDPYEAQELFKKYEDEIGIKMVPFEELVYVPELDQYVEINEAKKRNLKYINISGTEIRENFLKQGRKLPEWFTRPEVAEILAETYVPKHKQGFCVWLTGLPCAGKSTIAEILATMLQARGRKVTLLDGDVVRTHLSRGLGFSKEDRITNILRVGFVASEIVKHNGVVICALVSPYRSARNQVRNMMEEGKFIEVFVDAPVEVCEERDVKGLYKKAKEGLIKGFTGVDDPYEPPVAPEVRVDTTKLTPEESALKILEFLKKEGFIKD

SEQ ID NO: 438 - protein, 75 aa, Aquifex aeolicus
VGGGLLLHPVVGLTKPGDVDVYTRMRIYKVLYEKYYDKKKTILAFLPLAMRMAGPREALWHGIIRRNYGATHFIV

SEQ ID NO: 439 - protein, 37 aa, Aquifex aeolicus
VAEILAETYVPKHKQGFCVWLTGLPCAGKSTIAEILA

SEQ ID NO: 440 - protein, 362 aa, Pseudomonas fluorescens
MKSALKTFVPGALALLLLFPVAAQAKEVETKTKLANVVILATGGTIAGAGASAANSATYQAAKVGIEQLIAGVPELSQIANVRGEQVMQIASESINNENLLQLGRRVAELADSKDVDGIVITHGTDTLEETAYFLNLVEKTDKPIIVVGSMRPGTAMSADGMLNLYNAVAVAGSKDARGKGVLVTMNDEIQSGRDVSKMINIKTEAFKSPWGPLGMVVEGKSYWFRLPAKRHTMDSEFDIKTIKSLPDVEIAYGYGNVSDTAVKALAQAGAKAIIHAGTGNGSVSSKVVPALQELRKQGVQIIRSSHVNAGGFVLRNAEQPDDKYDWVVAHDLNPQKARILAMVALTKTQDSKELQRMFWEY

SEQ ID NO: 441 - protein, 370 aa, Mus musculus
MVGKLKQNLLLACLVISSVTVFYLGQHAMECHHRIEERSQPARLENPKATVRAGLDIKANKTFTYHKDMPLIFIGGVPRSGTTLMRAMLDAHPDIRCGEETRVIPRILALKQMWSRSSKEKIRLDEAGVTDEVLDSAMQAFLLEVIVKHGEPAPYLCNKDPFALKSLTYLARLFPNAKFLLMVRDGRASVHSMISRKVTIAGFDLNSYRDCLTKWNRAIETMYNQCMEVGYKKCMLVHYEQLVLHPERWMRTLLKFLHIPWNHSVLHHEEMIGKAGGVSLSKVERSTDQVIKPVNVGALSKWVGKIPPDVLQDMAVIAPMLAKLGYDPYANPPNYGKPDPKILENTRRVYKGEFQLPDFLKEKPQTEQVE

SEQ ID NO: 442 - protein, 62 aa, Meriones unguiculatus
SQVEQDGRSGHGLRRSSKFCLKEHKALKTLGIIMGTFTLCWLPFFIVNVVHAIKENLIPKEV

SEQ ID NO: 443 - protein, 29 aa, Meriones unguiculatus
KEHKALKTLGIIMGTFTLCWLPFFIVNVV

SEQ ID NO: 444 - protein, 572 aa, Rattus norvegicus
MHWLWKIPRLCTFWGTEMFHRTFHMNIKKLMPIQWGHQEVPAKFNFASDVIDHWASLEKAGKRSPGPALWWMNGSGEELKWNFRELSEISKQTANVLTGACGLQRGDRVAVVLPRVPEWWLVTLGCMRSGLVFMPGTTQMKSTDILYRLQSSKARAIVAGDEVVQEVDAVAPDCSFLKIKLLVSEKNREGWLNFKALLKDASPIHQCVETVSQESAAIYFTSGTSGPPKMAEHSHCSLGLKAKMDAGWTGLGPSDTMWTISDTGWILNILGSFLEPWVLGTCIFVHLLPKFDPQTVLKVLSSYPINTLLGAPLIYRMLLQQDLSSYKFPHLHSCFSGGETLLPETLESWKAKTGLEIREIYGQTETGITCRVSRTMKVKPGYLGTAIVPYDVQVIDEQGNVLPPGKEGDMALRVKPIRPIGMFSGYVDNPKKTQANIRGDFWLLGDRGIKDTEGYFHFMGRTDDIINSSGYRIGPSEVENALMEHPAVVETAVISSPDPIRREVVKAFVVLAPEFLSHDQDQLTKVLQEHVKSVTAPYKYPRKVEFVLDLPKTITGKIERAKLRAKEWKTSG

SEQ ID NO: 445 - protein, 739 aa, Rattus norvegicus
MSSENKEQHNLSPRDLPEEAYGFPPELPLGAQRGSSTDLRQFEPSDRRRAFRRIHMELHEKPDTNIRQLVMRKLQKSCQCNATKIRNRIFDFFPVLRWLPKYDLKKNILGDMMSGLIVGILLVPQSIAYSLLAGQEPIYGLYTSFFASIIYFLFGTSRHISVGIFGILCLMIGEVVDRELHKACPDIDTTSSSIAMFSNGCVVVNHTLDGLCDKSCYAIKIGSTVTFMAGVYQVAMGFFQVGFVSVYLSDALLSGFVTGASFTILTSQAKYLLGLSLPRSNGVGSVITTWIHIFRNIHKTNICDLITSLLCLLVLVPTKELNEYFKSKLPAPIPTELIVVVAATLASHFGKLNENYNSSIAGQIPTGFMPPQAPDWSLIPNVAVDAIAISIIGFAITVSLSEMFAKKHGYTVKANQEMYAIGFCNIIPSFFHCITTSAALAKTLVKESTGCQTQLSAIVTSLVLLLVLLLIAPLFYSLQKCVLGVITIVNLRGALLKFRDLPKMWRLSRMDTVIWFVTMLSSALLSTEIGLLVGVCFSMFCVILRTQMPKISLLGLEEESEIFESISTYKNLRSKSGIKVFRFIAPLYYINKECFKSALYKKTLNPVLVKAAWKKAAKRKLKEETVTFHGDPDEVSMQLSHDPLELHTVVIDCSAIQFLDTAGIHTLKEVRRDYEAIGIQVLLAQCNPSVRDSLAKGEYCKKEEENLLFYSLSEAVAFAEESQKEKGVCVVNGLSLSGD

SEQ ID NO: 446 - protein, 307 aa, Mus musculus
MASVLSYESLVHAVAGAVGSVTAMTVFFPLDTARLRLQVDEKRKSKTTHAVLLEIIKEEGLLAPYRGWFPVISSLCCSNFVYFYTFNSLKAVWVKGQRSSTGKDLVVGFVAGVVNVLLTTPLWVVNTRLKLQGAKFRNEDIIPTNYKGIIDAFHQIIRDEGILALWNGTFPSLLLVFNPAIQFMFYEGLKRQLLKKRMKLSSLDVFIIGAIAKAIATTVTYPMQTVQSILRFGRHRLNPENRTLGSLRNVLSLLHQRVKRFGIMGLYKGLEAKLLQTVLTAALMFLVYEKLTAATFTVMGLKSTHKH

SEQ ID NO: 447 - protein, 160 aa, Gallus gallus
LIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQ

SEQ ID NO: 448 - protein, 934 aa, Cyberlindnera jadinii
MFYHGASANQHWIAVDDLSKVPVDVDHYNVVPFQFRRAGEYKEPVLSGIVELDEVKFVVSQSDAAEQWQQLTAEDGTVWRSRAYHGKLGKYSDMAVGAFNKVLNLVRGAETFDIALVTCAYIAMFYTLFNLFARMRAVGSKVWLGLSTLVSSFFAFLFALYITTRVLDLSIPFLSLSEGIPFFVAVVGFNNKILLAEKVLQNQLNAQSSKNDAPTVLYQALREQGPLLLRDHLFMITAFLGCSFYASYLDGLKNFCILAALILAFDILTTSTFLSAILSLKLEINQIHRSTLLREQLEDDGLTETTVDDVLKSNSLAGTKTFTDAPSTLVTVAKVAGVSVFFGLHFYGFGSAWLSDLSAGNETNDTFTLYDAVADQIPIGSNGTLVTLFPTRFFLPEKLSTQIEAVVLSFIGLISTAARDKYISKFILFAFAVSASINVYLLNVARIHTTRLEDAIELKKPKKKASKTAVSVPKAVVVKDSETTKSSEILHSSSESESEQSSRPLEQVIELYKDGKVKTLVDDEVVSLVTAGKLPLYALEKQLGDNLRAVAIRRKAISDLADAPVLRSNKLPYLHYDYDRVFGACCENVIGYMPLPVGVAGPLIIDGKPYHIPMATTEGCLVASAMRGCKAINLGGGVTTVLTKDGMTRGPCVKFPSLKRAGQCKLWLDSDEGQEEMKKAFNSTSRFARLQHLQTALAGDLLFIRFRTVTGDAMGMNMISKGVEYALKQMTEVFGWDDMMVVSVSGNYCTDKKPAAVNWINGRGKSVVAEASIPKDAVVKVLKSSVKAVVDVNVNKNLIGSAMAGSVGGFNAQAANMVTAVYLALGQDPAQNVESSNCITLMTETEDGDLKVSVSMPSIEVGTIGGGTILDPQGSMLELLGVRGPADVPGENARQLAKIVASIVLSGELSLVSALAAGHLVQSHMQHNRAAAKK

SEQ ID NO: 449 - protein, 416 aa, Glomus mosseae
MSLSNKLSIRDLNVKDKRVLIRVDFNVPLDGTTITNNQRIVAALPTIKYALEQKAKTVVLMSHLGRPDGKKVDKYSLAPVAKEVERLLGKKVTFLEDCVGEGVENYVKNACDGEVILLENLRFHAEEEGSSKGPDGKKVKADLEKVKEFRRSLTALGDVYINDAFGTAHRAHSSMVGVELPQKAAGFLVKKELEYFAKALESPERPFLAILGGAKVSDKIQLIDNLIAKVDSLIICGGMAFTFKKTLENVKIGNSLFDADGAKTVGEVMEKAKKHDVEVVLPVDYITADKFAKDAQVGYATDQEGIPDGWMGLDCGEKSVELYKQTIAKAKTILWNGPAGVFEFDNFAKGTKATLDCAVEAAQSGKIVIIGGGDTATVAAKYGVEDKLSHVSTGGGASLELLEGKDLPGVSALSSK

SEQ ID NO: 450 - protein, 436 aa, Cunninghamella elegans [sequence omitted]

SEQ ID NO: 451 - protein, 297 aa, Schizosaccharomyces pombe
MDEFQTLKQNASWDISEDANDTPSLLVVILDANPASWYSLSKKVPVSKVLADITVFLNAHLAFHHDNRVAVLASHSDKVEYLYPSIAPEQKVAEVDPTKEANTYRKFREVDDLVLSGMKRLMSSTDKVSRKTMISGALSRALAYINQVQNKNTLRSRILIFSLTGDVALQYIPTMNCIFCAQKKNIPINVCNIEGGTLFLEQAADATGGIYLKVDNPKGLLQYLMMSLFPDQNLRKHLNTPNQANVDFRATCFCHKKVLDIGFVCSVCLSIFCEPRVHCSTCHTKFTVEPMSKKLHT

SEQ ID NO: 452 - protein, 298 aa, Schizosaccharomyces pombe
MVNAAIVVSSNRPNVLEQISSLFRDGKTRSLGEQWTLVSGQLKGTFEDAKDACNRISATENVDCNCLSEATFSTKKKLVVFDMDSTLIQQECIDELAAEAGIQKEVATITSLAMNGEIDFQESLRRRVSLLQGLSVDVINKVIGKITFTPGAKQLCHCLKQMGATLVVASGGFVPMAEYVKGQLDLDYAYANVLEFSDDGKFLTGKVQGAIVDGQRKASILREKREELGLNKLETMAVGDGANDLVMMAESGLGIAFKAKPKVQLLADSKINLPSLQNALYLLGIDEQQQKKLLENKN

SEQ ID NO: 453 - protein, 236 aa, Schizosaccharomyces pombe
MLILGLTGSIATGKSTVSREFQEKYHIKIIDADVLARKVVEPNTPCLIKIQKEFGNEVLHEDGTLNRAKLGQAVFQDAGKRSLLNSIIHPAVRLEMLKELLRCYVRGYSIVILDVPLLFEAKMQFICWKTICVSCDKSIQKQRLLARNPELTAEDAENRVQAQMPLELKCQLADIVIENNSDLETLYENIHNVLPLITPSYFFTLLCLILPPLQITLQVIAFVSQKKKVSEFRKHI

SEQ ID NO: 454 - protein, 338 aa, Schizosaccharomyces pombe
MGNSNSKSVKNDKENFEDPNATNFESVSQFKIRNVIGKGSWSTVFVVKHRQTKQRFALKCINKKKHDEHKIKKLRNEVLLLQSLNHPLLCKFYSEFEDETKIYLVTDLMLGGDLRYHISQRKFNESVIRIWMVELVSALIYIHSKGVLHRDVKPDNILLDEKGHCKLADFNVAAKVHTSSSPSKSNMTVGRVGTPVYMAPETLIHAVSYKESDWWSLGITFYECLFQVRPFPNHLLINWIRASEEEKASSADRLSSALHISRDKKLTTISKDARSAVMAFLEMDIKKRLGHSSKKLQTHPFFCSISLETVSKGNLTPIFRPKSGKVYVDPILDLEATF

SEQ ID NO: 455 - protein, 341 aa, Schizosaccharomyces pombe
MLRFVVGTYTHLIYGVDADIERKKCKPLWLFEAHEGALTALAVDGIYLASTSSDETIKIFDHTRNVQIADVSVPTDIANACIRDMCFTKNHLLACHDNGQISMWSKGSWLLVHTLKSSSHKGITGIAVHPSEKLALTVGGDGKLRLWDLVRGKGGKVLPLSTIPESILFLNESSFVIMSRRGIDAFKLDLTSLFSFSSKSQLNALCLYQSKLIVGRDNGTVLVLDTSDGKILHEFTAHKKRVKSVYPVDDYLITASSDGSVCIWDKDWNLVIEHNIPEGNRITCMVAMLADSNSEPKNVEDEAAKRQSLDSETSETSSESESESEYYSTSKQPPVKRTKHA

SEQ ID NO: 456 - protein, 121 aa, Schizosaccharomyces pombe
AFKLDLTSLFSFSSKSQLNALCLYQSKLIVGRDNGTVLVLDTSDGKILHEFTAHKKRVKSVYPVDDYLITASSDGSVCIWDKDWNLVIEHNIPEGNRITCMVAMLADSNSEPKNVEDEAAK

SEQ ID NO: 457 - protein, 30 aa, Schizosaccharomyces pombe
MLRFVVGTYTHLIYGVDADIERKKCKPLWL

SEQ ID NO: 458 - protein, 257 aa, Schizosaccharomyces pombe
MSVYSFSDVSLVAKALGAFVKEKSEASIKRHGVFTLALSGGSLPKVLAEGLAQQRGIEFSKWEVFFADERIVPLDDENSNYALCKKLIFDKFEGFDPKKIHTINPELLKENPIDPQNVADEYEKQLVHVFANSSTVKVPVFDLLLLGCGPDGHTCSLFPDHEVLQEDVAWVAPVTDSPKPPKDRITLTLPVVTHAQAIAFVTTGAGKKDILPIVIEDFTSKLPSALITRNNLTRTSWFVDDEASANLERSSLKVFPQ

SEQ ID NO: 459 - protein, 119 aa, Schizosaccharomyces pombe
VGCILAYFIFQEYKNVGKPIDDFYVLSTTVSSAMVKSMAKVEGFHHVETLTGFKWLGNKALELEKQGKFIGLAYEEALGYMVGSIVRDKDGVNALITFLHLLKRLQLQNLSITEVFEQM

SEQ ID NO: 460 - protein, 111 aa, Schizosaccharomyces pombe
IFQEYKNVGKPIDDFYVLSTTVSSAMVKSMAKVEGFHHVETLTGFKWLGNKALELEKQGKFIGLAYEEALGYMVGSIVRDKDGVNALITFLHLLKRLQLQNLSITEVFEQM

SEQ ID NO: 461 - protein, 329 aa, Schizosaccharomyces pombe
MSNLLVQVSKTGPSSVLQVITKEIPKPAPNGLVIKNAYAGLNYIDTYLRTGLYTAPLPYIPGKEAAGVVAAVGDKVEADFKVGDRVVYLTPFGAYAQYTNVPTTLVSKVSEKIPLKIASAALLQGLTAYTLIEEAYPVKTGDTVVVHAAAGGVGLLLCQMLRARNVHVIATASTAAKRRIAIKNGAEIACSYEDLTKVVADYTNGKGVDAAYDSVGIDTLSSSLDALRNGGTMVSFGNASGAIDAIPLKFLSARCLKFVRPSLFGYITGHAVFEGYVSRLWKEILDNNLNIAIHHIFKLSEAKEAHDAIESRATTGKLLLLCNEDLADA

SEQ ID NO: 462 - protein, 150 aa, Schizosaccharomyces pombe
EALEFASAISKGKVSIYNKNKILELSKKTAKSKVWNLDDFFTIEIPHMMAVVPHDDGINLSFMCESKVFDLESVDSVTCNYVLSSSKNPMNLLFTLHNSITDGKLNVHCNDIIPGRYHLKTIVFKLKDSVLSFQKDCLHSNKQIEVLNPT

SEQ ID NO: 463 - protein, 109 aa, Schizosaccharomyces pombe
LELSKKTAKSKVWNLDDFFTIEIPHMMAVVPHDDGINLSFMCESKVFDLESVDSVTCNYVLSSSKNPMNLLFTLHNSITDGKLNVHCNDIIPGRYHLKTIVFKLKDSVL

SEQ ID NO: 464 - protein, 222 aa, Schizosaccharomyces pombe
MENNHHLAKDSLDELNPKRGKGEHETQVSQYTVVEEATIPQSLVKTSRPADHKVMEASKVADTRTAWSTKIPAVLLPVFVINIALFKYLVFANFSTKDRVLFGLGNGGINIFSMWLLLATYETWFRSIKEVIVACGAGIRSFPQKRGVNMLYAILKLTFVNAFAIPLLMFFRSHFEQWRLGCPLVERVIGVMLNVAYFIIEIGSFFKILINANFTRKSWFIH

SEQ ID NO: 465 - protein, 333 aa, Schizosaccharomyces pombe
MKNNYTSLKSPLDEEDELKTDHEIDLEKGPLPEYDSEEEGALPPYSDHALVNNPPNTHRENHSSGTTDNSSPLLIKLLISFTSIILFNAPAVCYLKYKDAFFKNYGAVEWTLFGFWCFVCTLALIFLTYFYETWTKAVKVTVISLAQCVKVTAVFLAKCVKVTAVGLYNSREKWVVIIWLLWVVICYTLFLRAKFGNLNLDKALICSTCSISAALLLFLLYVRLPFWTLKHMFSGLFQVLGVQSCVVIVQKGLMHLFDKHIDGTGYEIEASSLFVIGNFLFFYEMECPGALKRMPKFIRNGIASFLGGIANAIGGANDNNDIPLEETEAESEV

SEQ ID NO: 466 - protein, 260 aa, Drosophila melanogaster
MQLTGASMFLVWVGLLSWVSCRVDASEGFPSPLKRCKLQDESCLLAQAQTFFQAFKNGIPERQVAALEPIALGTMFIESGGHSESIKFKLTMSDAKLYNLANSMMVKSLKGFTKDLTRPLKLTLLLDNPELEVRAKYDVDGKLLILPIVSKGDLTIRLNDVHTKVWITAEPVKRSDGHTYLNITDYKTATKIKGGHFDLSNLFNDNKELRDSTLKVLNQEWSTLALDVQPKINEACAKAFSAIVQSLWANIPYDEFFEKE

SEQ ID NO: 467 - protein, 390 aa, Bos taurus
MRVLLRCCCGHLPVGGGAGRRSNPRWRALARLSASPGWEDGQGARVREKPPWRVLFFGNDQFARETLRALHAARENKEEELIEKLEVVTVPSPSPKGLPVKQYAVQSQLPVYEWPDVGSGEYDVGVVASFGRLLSEAFILKFPYGILNVHPSCLPRWRGPAPIIHTILHGDTIAGVTIMQIKPRRFDVGPILKQETVPVPPKSTSKELEAVLSRLGANMLISVLKNLPESLNNGRQQPAEGVTHAPKISAATSCIKWEEQTSEQIFRLYRAVGNIIPLQTLWMDNTIKLLDLVEVDNSILSDSKLTGQAVIPGSVIYHKQSQILLVCCKDDWIGVRSVMLKKTLTATDFYNGYLHPWYQKNSQAQPSQCRFQTLRLPPKKKQKKKIVAMQ

SEQ ID NO: 468 - protein, 73 aa, Bos taurus
MDNTIKLLDLVEVDNSILSDSKLTGQAVIPGSVIYHKQSQILLVCCKDDWIGVRSVMLKKTLTATDFYNGYLH

SEQ ID NO: 469 - protein, 65 aa, Bos taurus
LVEVDNSILSDSKLTGQAVIPGSVIYHKQSQILLVCCKDDWIGVRSVMLKKTLTATDFYNGYLHP

SEQ ID NO: 470 - protein, 531 aa, Oryctolagus cuniculus
MAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQVLEQIKVSREMDRETLIDVARTSLRTKVHAELADVLTEAVVDSILAIKKQDEPIDLFMVEIMEMKHKSETDTSLIRGLVLDHGARHPDMKKRVEDAYILTCNVSLEYEKTEVNSGFFYKSAEEREKLVKAERKFIEDRVKKIVELKKKVCGDSDKGFVVINQKGIDPFSLDALAKEGIVALRRAKRRNMERLTLACGGVPLNSLDDLNPDCLGHAGLVYEYTLGEEKFTFIEKCNNPRSVTLLVKGPNKHTLTQIKDAIRDGLRAVKNAIDDGCVVPGAGAVEVAMAEALIKYKSSVKGRAQLGVQAFADALLIIPKVLAQNSGFDLQETLVKIRTEHSESGQLVGVDLNTGEPMVAAEVGIWDNYCVKKQLLHSCTVIATNILLVDEIMRAGMSSLKG

SEQ ID NO: 471 - protein, 398 aa, Bos taurus
MALLRRPTVSTDLENNDTGVNSKPKSHVTIRRAVLEEIGNRVTTRAIQVAKKAQNTKVPVPPTKTTNVNKHPKPTASVKPVQMDVLAPKGPSPTPQDISMKEENLCQAFSDALLCKIEDIDTEDWENPQLCSDYVKDIYQYLRQLEVLQSINPHFLDGRDINGRMRAILVDWLVQVHSKFRLLQETLYMCVAVMDRYLQVQPVSRKKLQLVGITALLLASKYEEMFSPNIEDFVYITDNAYTSSQIREMETLILKELKFELGRPLPLHFLRRASKAGEVDVEQHTLAKYLMELTLVDYDMVHYHPSKVAAAASCLSQKVLGQGKWNLKQQYYTGYTESEVLEVMRHMAKNVVRVNENMTKFTAIKNKYASSKLLKISTIPQLNSKAIQELASPLLGRS

SEQ ID NO: 472 - protein, 394 aa, Humulus lupulus
MASVTVEQIRKAQRAEGPATILAIGTAVPANCFNQADFPDYYFRVTKSEHMTDLKKKFQRMCEKSTIKKRYLHLTEEHLKQNPHLCEYNAPSLNTRQDMLVVEVPKLGKEAAINAIKEWGQPKSKITHLIFCTGSSIDMPGADYQCAKLLGLRPSVKRVMLYQLGCYAGGKVLRIAKDIAENNKGARVLIVCSEITACIFRGPSEKHLDCLVGQSLFGDGASSVIVGADPDASVGERPIFELVSAAQTILPNSDGAIAGHVTEAGLTFHLLRDVPGLISQNIEKSLIEAFTPIGINDWNNIFWIAHPGGPAILDEIEAKLELKKEKMKASREMLSEYGNMSCASVFFIVDEMRKQSSKEGKSTTGDGLEWGALFGFGPGLTVETVVLHSVPTNV

SEQ ID NO: 473 - protein, 496 aa, Arabidopsis thaliana
MAGGGTTLEYTPTWVVALVCSVIVSISFAVERLIHRAGKHFKNNDQKQLFGALQKIKEELMLVGFISLLLSVGQSKIAKICISKELSEKFLPCTKPAGAEKSLKDSSHFQFSFTGRHLLAGDAPAGDYCSLKGKVPIMSLSALHELHIFIFVLAVAHIIFCLLTIVFGTMKIKQWKKWEDKVLEKDFDTDQSIKKFTHVQEHEFIRSRFLGVGKADASLGWVQSFMKQFLASVNESDYITMRLGFVTTHCKTNPKFNFHKYLMRALNSDFKKVVGISWYLWVFVVLFLLLNIVAWHVYFWLAFIPLILLLAVGTKLEHIITDLAHEVAEKHIAVEGDLVVRPSDDLFWFQSPRLVLFLIHFILFQNSFEIAYFFFILFQFGWDSCIMDHVKFVIPRLVIGVIIQLLCSYSTLPLYALVTQMGSSFKGAIFNEQTQEHLVGWAKMAKRGVKKGATQVGTSHDATSPRPSIQLNSLLGKGSSQQNQNPKEKSEIAHHD

SEQ ID NO: 474 - protein, 31 aa, Arabidopsis thaliana
LHIFIFVLAVAHIIFCLLTIVFGTMKIKQWK

SEQ ID NO: 475 - protein, 62 aa, Arabidopsis thaliana
MAGGGTTLEYTPTWVVALVCSVIVSISFAVERLIHRAGKHFKNNDQKQLFGALQKIKEELML

SEQ ID NO: 476 - protein, 166 aa, Arabidopsis thaliana
MVLKVYGPHFASPKRALVTLIEKGVAFETIPVDLMKGEHKQPAYLALQPFGTVPAVVDGDYKIFESRAVMRYVAEKYRSQGPDLLGKTVEDRGQVEQWLDVEATTYHPPLLNLTLHIMFASVMGFPSDEKLIKESEEKLAGVLDVYEAHLSKSNIHSQLKMCSSSW

SEQ ID NO: 477 - protein, 311 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQEKFCRATEFAHETHGFYKTIEELWDGEI

SEQ ID NO: 478 - protein, 291 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQAREVLPSY

SEQ ID NO: 479 - protein, 290 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQAKVLPSY

SEQ ID NO: 480 - protein, 867 aa, Arabidopsis thaliana
MTTFMVSKRFRPPIFLHRFINPKPISSQTRFLHPPDNQSRDISDSTTETISTLEFPHKTSVPNHSPLTSTSETENHVDDARVIEVLLGRRNDPVSALQYCNWVKPLHRLCEGGDVFWVLIHILLSSIHTHDRASNLLVMFVSNNPTLIPNVMVNNLVDSSKRFGFELTPRAFNYLLNAYIRNKRMDYAVDCFGLMVDRKVVPFVPYVNNVLSSLVRSNLIDEAKEIYNKMVLIGVAGDNVTTQLLMRASLRERKPEEAVKIFRRVMSRGAEPDGLLFSLAVQAACKTPDLVMALDLLREMRGKLGVPASQETYTSVIVAFVKEGNMEEAVRVMDEMVGFGIPMSVIAATSLVNGYCKGNELGKALDLFNRMEEEGLAPDKVMFSVMVEWFCKNMEMEKAIEFYMRMKSVRIAPSSVLVHTMIQGCLKAESPEAALEIFNDSFESWIAHGFMCNKIFLLFCKQGKVDAATSFLKMMEQKGIEPNVVFYNNMMLAHCRMKNMDLARSIFSEMLEKGLEPNNFTYSILIDGFFKNKDEQNAWDVINQMNASNFEANEVIYNTIINGLCKVGQTSKAKEMLQNLIKEKRYSMSCTSYNSIIDGFVKVGDTDSAVETYREMSENGKSPNVVTFTSLINGFCKSNRMDLALEMTHEMKSMELKLDLPAYGALIDGFCKKNDMKTAYTLFSELPELGLMPNVSVYNSLISGFRNLGKMDAAIDLYKKMVNDGISCDLFTYTTMIDGLLKDGNINLASDLYSELLDLGIVPDEILHMVLVNGLSKKGQFLKASKMLEEMKKKDVTPNVLLYSTVIAGHHREGNLNEAFRLHDEMLEKGIVHDDTVFNLLVSGRVEKPPAASKISSLASPEMRSSY

SEQ ID NO: 481 - protein, 80 aa, Arabidopsis thaliana
ETPTWAVAVVCFVLLFISIMIEYFLHFIGHWFKKKHKKALSEALEKVKAELMLLGFISLLLVVLQTPVSEICIPRNIAAT

SEQ ID NO: 482 - protein, 30 aa, Arabidopsis thaliana
LHIFIFVLAVFHVLYCIITYALGKTKMKKW

SEQ ID NO: 483 - protein, 74 aa, Arabidopsis thaliana
CAAEYLGMHETVEKGNLIYKIDVFLSSSLFRSWKDSIIVLQTTKPFLPLSEDLKLVSLCIDAIATKACVDVSHV

SEQ ID NO: 484 - protein, 83 aa, Arabidopsis thaliana
AYNVVATRCAAEYLGMHETVEKGNLIYKIDVFLSSSLFRSWKDSIIVLQTTKPFLPLSEDLKLVSLCIDAIATKACVDVSHVE

SEQ ID NO: 485 - protein, 118 aa, Arabidopsis thaliana
PTGKKLAKKLEVPFDKRFNHSAALSTSQYGVKKSELLKINFAWQKQLMKQNAFIYVFKFVQLLLVALITMTVFCRTTMHHNTIDDGNIYLGSLYFSMVIILFNGFTEVPMLVAKLPVL

SEQ ID NO: 486 - protein, 91 aa, Arabidopsis thaliana
VKKSELLKINFAWQKQLMKQNAFIYVFKFVQLLLVALITMTVFCRTTMHHNTIDDGNIYLGSLYFSMVIILFNGFTEVPMLVAKLPVLYKH

SEQ ID NO: 487 - protein, 1014 aa, Arabidopsis thaliana
MESYLNENFDVKAKHSSEEVLEKWRNLCGVVKNPKRRFRFTANLSKRYEAAAMRRTNQEKLRIAVLVSKAAFQFISGVSPSDYTVPEDVKAAGFEICADELGSIVESHDVKKLKFHGGVDGLAGKLKASPTDGLSTEAAQLSQRQELFGINKFAESEMRGFWVFVWEALQDMTLMILGVCAFVSLIVGIATEGWPKGSHDGLGIAASILLVVFVTATSDYRQSLQFRDLDKEKKKITVQVTRNGFRQKLSIYDLLPGDIVHLAIGDQVPADGLFLSGFSVVIDESSLTGESEPVMVNAQNPFLMSGTKVQDGSCKMMITTVGMRTQWGKLMATLTEGGDDETPLQVKLNGVATIIGKIGLFFAVVTFAVLVQGMFMRKLSTGTHWVWSGDEALELLEYFAIAVTIVVVAVPEGLPLAVTLSLAFAMKKMMNDKALVRHLAACETMGSATTICSDKTGTLTTNHMTVVKSCICMNVQDVANKGSSLQSEIPESAVKLLIQSIFNNTGGEVVVNKHGKTELLGTPTETAILELGLSLGGKFQEERKSYKVIKVEPFNSTKKRMGVVIELPEGGRMRAHTKGASEIVLAACDKVVNSSGEVVPLDEESIKYLNVTINEFANEALRTLCLAYMDIEGGFSPDDAIPASGFTCVGIVGIKDPVRPGVKESVELCRRAGITVRMVTGDNINTAKAIARECGILTDDGIAIEGPVFREKNQEELLELIPKIQVMARSSPMDKHTLVKQLRTTFDEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNDELMKRLPVGRRGNFITNAMWRNILGQAVYQFIVIWILQAKGKAMFGLDGPDSTLMLNTLIFNCFVFCQVFNEISSREMEEIDVFKGILDNYVFVVVIGATVFFQIIIIEFLGTFASTTPLTITQWIFSIFIGFLGMPIAAGLKTIPV

SEQ ID NO: 488 - protein, 124 aa, Arabidopsis thaliana
VVQKCRKKLQCLILDNWQRSWVLLVWVMLMAILFVWKFLEYREKAAFKVMGYCLTTAKGAAETLKLNMALVLLPVCRNTLTWLRSTRARACVPFDDNINFHKIIACAIAIGILVHAGTHLACDF

SEQ ID NO: 489 - protein, 94 aa, Arabidopsis thaliana
THHLLVVVYIMLIVHGTFLFFADKWYQKTTWMYISVPLVLYVAERSLRACRSKHYSVKILKVSMLPGEVLSLIMSKPPGFKYKSGQYIFLQCPT

SEQ ID NO: 490 - protein, 428 aa, Arabidopsis thaliana
MANSSIVALLLLFVIASSVNGGDQEYPNQYLTEALGDKEWLVSVRRQIHENPELLFELHKTSALIRRELDELGVSYSYPVAKTGIVAQIGSGYPPVVALRADMDALPLQELVEWDHKSKIDGKMHACGHDSHTTMLLGAAKLLSKRKRMLNGTVRLLFQPAEEGGAGAFHMIKEGALGDSEAIFGMHVHTGLPTGELATISGPALASTSIFSVRMSGKSPASSETYSCVDPVLAASSTILALQLIISREVDPLLSHVLSVTFMKSGGSEFDVIPAYVEFGGTLRSLTTNGINWLIKRLKEVVEGQAEVQRCKADIDMHEDDHPMYPATVNDHKLHEFTEKVLKLLLGPEKVKPANKVMAGEDFAFYQQKIPGYYIGIGIRNEEIGSVRSVHSPYFFLDENVLPIGSATFAALAEMYLQEHQNQTKSGD

SEQ ID NO: 491 - protein, 359 aa, Capsicum chinense
MGSINQSLTQTEDEAFVFAMQLASASVLPMVLKATVELDLLEIMAKSGPGAFISPSELAAQLPTKNPEAPVMLDRMFRLLATYSVLNCTLRTLPDGRVERLYSLAPVCKFLTKNGDGVSIAPILLMNQDKVLMESWYHLTDAVLDGGVPFNKAYGMTTFEYHGTDPRFNKVFNCGMSDHTTLSMKKILEDYTGFEGLNSIVDVGGGTGATVNMIVSKYPSIKGINFDLPHVIRDAPSYPGVEQVGGDMFVSVPKADAIFMKWICHDWSDDHCIKLLKNCYEALPANGKVIIVECILPEAPDTSAATKSKVHGDIIMLAHNPGGKERTEKDFEALANWGWFSRFRKVCCAYHTWVMEFNK

SEQ ID NO: 492 - protein, 893 aa, Arabidopsis thaliana
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQKCLKDDDPYVRKTAAICVAKLFDINAELVEDRGFLEALKDLISDNNPMVVANAVAALAEIQENSTSPIFEINSTILTKLLTALNECTEWGQVFILDALSRYKASDPREAENIVERVTPRLQHANCAVVLSAVKMILQQMELITSTDVIRNLCKKMAPPLVTLLSAEPEIQYVALRNINLIVQKRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLENFPEEPAQVQLQLLTATVKLFLKKPTEGPQQMIQVVLNNATVETDNPDLRDRAYIYWRLLSTDPEAAKDVVLAEKPVITDDSNQLDPSLLDELLANISTLSSVYHKPPEAFVTRLKTTVQKTEDEDYVEGSETGYPEASGNPVDGAASPSATTGYVTKLAAAPAPVPDLLGDLMGSDNAAIVPVDEPTTPSGRPLPVVLPASKGQGLQISAQLTRQDGQVFYSMLLENNSQSLLDGFMIQFNKNSFGLAAVGSLQVPPLQPGASARTMMPMVLSQNMSTGSTSSVLQVAVKNNQQPVWYFEDKIVLNALFSEDGRMERGTFLETWKSLPDSNEVQKEFPGITITSVESTLDLLAASNMFFIAKRKNGNQDVLYLSAKVPRGIPFLIELTAIVGQPGLKCAVKTPTPEIAPLFFEAVEILFKA

SEQ ID NO: 493 - protein, 200 aa, Arabidopsis thaliana
HQSNFAATSTFIAREIAQGLMKYQPDIIISVHPLMQHVPLRVLRSKGLLKKIVFTTVITDLSTCHPTWFHKLVTRCYCPSTEVAKRAQKAGLETSQIKVYGLPVRPSFVKPVRPKVELRRELGMDENLPAVLLMGGGEGMGPIEATARALADALYDKNLGEAVGQVLIICGRNKKLQSKLSSLDWKIPVQVKGFITKMEE

SEQ ID NO: 494 - protein, 29 aa, Arabidopsis thaliana
LLKKIVFTTVITDLSTCHPTWFHKLVTRC

SEQ ID NO: 495 - protein, 200 aa, Arabidopsis thaliana; identical to SEQ ID NO: 493

SEQ ID NO: 496 - protein, 29 aa, Arabidopsis thaliana
LLKKIVFTTVITDLSTCHPTWFHKLVTRC

SEQ ID NO: 497 - protein, 510 aa, Glycine max
  MOD_RES (150)..(150): Any amino acid
MAFQVLFICLISTIVFASILWRKQNKNKTLLPPSPMPLPIIGHLHLLSPTPHQDFHKLSLRYGPIIHLFLGSVPCVVASTAEAAKEFLKTHEPAFSNRPANTVAVETLTYGFQDFLFAPYGPYWKFMKKLCMSELLGGHMLDQFLPVRQXETKKFIKRVLQKGISGEAVDFGGEFITLSNNIVSRMIVSQTSTTEDENEVEEMRKLVKDAAELSGKFNISDFVSFLKRFDLQGFNKRLEKIRDCFDTVLDRIIKQREEERRNKNETVGKREFKDMLDVLFDISEDESSEIKLNKENIKAFILDILIAGTDTSAVTMEWAMAELINNPGVLEKARQEMDAVVGKSRIVEESDIANLPYLQGIVRETLRLHPAGPLLFRESSRRAVVCGYDIPAKTRLFVNVWAIGRDPNHWENPLEFRPERFVENGKSQLDVRGQHYHLLPFGSGRRACPGTSLALQVVHVNLAVLIQCFQWKVDCDNGKVNMEEKAGITLPRAHPIICVPIRRLNPFPVV

SEQ ID NO: 498 - protein, 389 aa, Hydrangea macrophylla
MVTVEEVRKAQRAEGPATILAIGTATPPNYVDQSTYPDFYFRVTNSEHKKELKAKFQRMCDNSQIKKRYMHLTEEILKENPNICAYMAPSLDARQDMVVVEIPKLGKEAATRAIKEWGQPKSKITHLVFCTTSGVDMPGADYQLTKLLGLRPSVKRLMMYQQGCFAGGTVLRLAKDLAENNKGARVLVVCSEITAVTFRGPSDTHLDSLVGQALFGDGAAAVIIGSDPMPEVEKPLFEIVSAAQTILPDSDGAIDGHLREVGLTFHLLKDVPGLISKNIEKSLVEAFRPLDISDWNSIFWIAHPGGPAILDQVEKKLALKPEKLRATRNVLSDYGNMSSACVLFIMDEMRKNSAEEGLMTTGEGLEWGVLFGFGPGLTVETVVLHGVST

SEQ ID NO: 499 - protein, 255 aa, Arabidopsis thaliana
MAEEIEKSVPTEESLMEKISEKIHHHDSSSSSESEYEKPDSPSAVKAKIYRMFGREKPVHKVLGGGKPADVFLWRDKKLSGAVLGVATAIWVLFELVEYHLLSLLCHISILALGGLFLWSNAHTLINKTSPQIPEIHVPEEAFLVVASSLRNELNQAFVILRSIALGRDLKKFLMVVVGLWIISVVGNWFNFLTLVYICFVILHTVPMLYEKHEDKVDPLAEKAMKELQKQYVVFDEKVLSKIPIASLKAKAKLG

SEQ ID NO: 500 - protein, 359 aa, Medicago sativa
MAKSPETELPLKAFGWAARDTSGTLSPFHFSRRENGDDDVSVKILYCGVCHSDLHTLKNDWGFTTYPVVPGHEIVGVVTKVGINVKKFRVGDNVGVGVIVESCQTCENCNQDLEQYCPKPVFTYNSPYKGTRTYGGYSDFVVVHQRYVVQFPDNLPLDAGAPLLCAGITVYSPMKYYGMTEPGKHLGVAGLGGLGHVAIKFGKAFGLKVTVISTSPNKETEAIDKLGADSFLVSKDPEKMKAAMGTMDYIIDTISAAHSLMPLLGLLKLNGKLVTVGLPSKPLELSVFPLVAGRKLIGGSNIGGMKETQEMLDFCGKHNITADIELIKMHEINTAMERLHKADVKYRFVIDVANSFSSL

SEQ ID NO: 501 - protein, 437 aa, Arabidopsis thaliana
MKAFRSLRILISISRTTTKTTPRNPHQAQNFLRRFYSAQPNLDEPTSINEDGSSSDSVFDSSQYPIDDSNVDSVKKPKEATWDKGYRERVNKAFFGNLTEKGKVKVAEEESSEDDEDSVDRSRILAKALLEAALESPDEELGEGEVREEDQKSLNVGIIGPPNAGKSSLTNFMVGTKVAAASRKTNTTTHEVLGVLTKGDTQVCFFDTPGLMLKKSGYGYKDIKARVQNAWTSVDLFDVLIVMFDVHRHLMSPDSRVVRLIKYMGEEENPKQKRVLCMNKVDLVEKKKDLLKVAEEFQDLPAYERYFMISGLKGSGVKDLSQYLMDQAVKKPWEEDAFTMSEEVLKNISLEVVRERLLDHVHQEIPYGLEHRLVDWKELRDGSLRIEQHLITPKLSQRKILVGKGGCKIGRIGIEANEELRRIMNRKVHLILQVKLK

SEQ ID NO: 502 - protein, 421 aa, Arabidopsis thaliana
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVRLEGTNVEQGKRILKESGMKLITADDLDDAAEKAVKALAH

SEQ ID NO: 503 - protein, 257 aa, Chlamydia trachomatis
MCIKRKKTWIAFLAVVCSFCLTGCLKEGGDSNSEKFIVGTNATYPPFEFVDKRGEVVGFDIDLAREISNKLGKTLDVREFSFDALILNLKQHRIDAVITGMSITPSRLKEILMIPYYGEEIKHLVLVFKGENKHPLPLTQYRSVAVQTGTYQEAYLQSLSEVHIRSFDSTLEVLMEVMHGKSPVAVLEPSIAQVVLKDFPALSTATIDLPEDQWVLGYGIGVASDRPALALKIEAAVQEIRKEGVLAELEQKWGLNN

SEQ ID NO: 504 - protein, 258 aa, Bacillus megaterium
MKLYIIGAGPGDPDLITVKGLKLLQQADVVLYADSLVSQDLIAKSKPGAEVLKTAGMHLEEMVGTMLDRMREGKMVVRVHTGDPAMYGAIMEQMVLLKREGVDIEIVPGVTSVFAAAAAAEAELTIPDLTQTVILTRAEGRTPVPEFEKLTDLAKHKCTIALFLSATLTKKVMKEFINAGWSEDTPVVVVYKATWPDEKIVRTTVKDLDDAMRTNGIRKQAMILAGWALDPHIHDKDYRSKLYDKTFTHGFRKGVKSE

SEQ ID NO: 505 - protein, 119 aa, Mus musculus
DDHKGRIKCQNNYIVSTDWESKEHQTLGQWIHAACFVGRFLLGFLLPFLVIIFCYKRVATKMKEKGLFKSSKPFKVMVTAVISFFVCWMPYHVHSGLVLTKSQPLPLHLTLGLAVVTIS

SEQ ID NO: 506 - protein, 112 aa, Mus musculus
IKCQNNYIVSTDWESKEHQTLGQWIHAACFVGRFLLGFLLPFLVIIFCYKRVATKMKEKGLFKSSKPFKVMVTAVISFFVCWMPYHVHSGLVLTKSQPLPLHLTLGLAVVTI

SEQ ID NO: 507 - protein, 930 aa, Rattus norvegicus
MNKIRKFFRGSGRVLAFIFVASVIWLLFDMAALRLSFSEINTGILKEDIMRREQTGFRVEADQMTILSPSSRGMRPPRNGAGGKESFRKAENRVLKVEENVDQVQRKGKMQFLLGRGKAVSLWHRTHVQTLPVTLPMQKTQGRDSKPEVSSLHMMSKQTTVLGSEKDSFTVSRGVPLNKTAEHTETLDKKQEAPENYNLSSDTSKQASQRALNVTISVRTDRSKQQSQTVTKSSIQFASLPILKPEEVTVTKKTEAQGKDLKYEAHKARPLLKFTADVGHLKKQSTNETGLGVLPEADGAKVAPGKKLNFSESQIVIITKEEGQKTDTKEVPNSKIQTVFPKLLGESQGKHIPRSQSQTLSSPLAPKRAVSQSKPTLAEELHTARSNLTAKATTVGHQQSHANISENPGKHHVLRIDVTLSPRDLNAPGQFGRPVVVPPGKKKEAEQRWKEGNFNVYLSDLIPVDRAIEDTRPAGCAEQLVHNDLPTTSIIMCFVDEVWSALLRSVHSVLNRSPPHLIKEILLVDDFSTKDYLKANLDKYMSQFPKVRILRLKERHGLIRARLAGAQNATGDVLTFLDSHVECNVGWLEPLLERVYLNRKKVACPVIEVINDKDMSYMTVDNFQRGVFTWPMNFGWRTIPPDVIAKNGIKETDIIRCPVMAGGLFSIDKSYFYELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCQSFKWYLDNVFPDLKAPVVRASGVFINLALGKCVSIKNITVVLEDCDGSSELQQFNYTWVRLIKHGEWCVAPIPDKGSLTLYPCDNRNNRLKWLHRSASAFHPELVDHIVFESYQQLLCMEGNFSQKTLKLAACNPTEPQQKWKFEKYYDV

SEQ ID NO: 508 - protein, 621 aa, Mus musculus
MSANFKMNHKRDQQKSTNVVYQAHHVSRNKRGQVVGTRGGFRGCTVWLTGLSGAGKTTISFALEEYLVSHAIPCYSLDGDNVRHGLNKNLGFSAGDREENIRRIAEVARLFADAGLVCITSFISPFAKDRENARKIHESAGLPFFEIFVDAPLNICESRDVKGLYKRARAGEIKGFTGIDSDYEKPETPECVLKTNLSSVSDCVQQVVELLQEQNIVPHTTIKGIHELFVPENKVDQIRAEAETLPSLPITKLDLQWVQILSEGWATPLKGFMREKEYLQTLHFDTLLDGVVPRDGVINMSIPIVLPVSADDKARLEGCSKFALMYEGRRVALLQDPEFYEHRKEERCSRVWGTATAKHPHIKMVMESGDWLVGGDLQVLERIRWDDGLDQYRLTPLELKQKCKDMNADAVFAFQLRNPVHNGHALLMQDTRRRLLERGYKHPVLLLHPLGGWTKDDDVPLEWRMKQHAAVLEERVLDPKSTIVAIFPSPMLYAGPTEVQWHCRCRMIAGANFYIVGRDPAGMPHPETKKDLYEPTHGGKVLSMAPGLTSVEIIPFRVAAYNKIKKAMDFYDPARHEEFDFISGTRMRKLAREGEDPPDGFMAPKAWKVLTDYYRSLEKTN

SEQ ID NO: 509 - protein, 92 aa, Mus musculus
MATLRVPLLVALVLLAVAIQTSDAGPYGANVEDSICCQDYIRHPLPSRLVKEFFWTSKSCRKPGVVLITVKNRDICADPRQVWVKKLLHKLS

SEQ ID NO: 510 - protein, 200 aa, Rattus norvegicus
LLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKK

SEQ ID NO: 511 - protein, 36 aa, Rattus norvegicus
HPNVVTYYTSFVVKDELWLVMKLLSGGSMLDIIKYI

SEQ ID NO: 512 - protein, 953 aa, Rattus norvegicus
MITSAAGIISLLDEEEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDTQAVSDILEKLVKEDNLLMAYQICFDLYESASQQFLSSVIQNLRTVGTPIASVPGSTNTGTVPGPEKDSDSMETEEKTAGAVAGKTPDASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNTQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGVCCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCIIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLSMTETCRYQPFKPLSIGGIIILKDTSEDIEELVEPVAAHGPKIEEEEQEPEPPEPFEYIDD

SEQ ID NO: 513 - protein, 136 aa, Rattus norvegicus
TFNIRVPKVHGKNKPLITYVGDSTVLKCECQNCLPLNWTWYMSNGTAQVPIDVHVNDKFDINGSYANETKLKVKHLLEEDGGSYWCRAAFPLGESEEHIKLVVLSFMVPLKPFLAIIAEVILLVAIILLCEVYTQK

SEQ ID NO: 514 - protein, 130 aa, Rattus norvegicus
LITYVGDSTVLKCECQNCLPLNWTWYMSNGTAQVPIDVHVNDKFDINGSYANETKLKVKHLLEEDGGSYWCRAAFPLGESEEHIKLVVLSFMVPLKPFLAIIAEVILLVAIILLCEVYTQKKKNDPDDGK

SEQ ID NO: 515 - protein, 107 aa, Mus musculus
VTIAGFDLSSYRDCLTKWNKAIEVMYAQCMEVGRDKCLPVYYEQLVLHPRRSLKRILDFLGIAWSDTVLHHEDLIGKPGGVSLSKIERSTDQVIKPVNLEALSKWTG

SEQ ID NO: 516 - protein, 1249 aa, Mus musculus
MDAKARNCLLQHREALEKDIKTSYIMDHMISNGVLSVIEEEKVKSQATQYQRAAALIKMILNKDNCAYISFYNALLHEGYKDLAALLQSGLPLVSSSSGKDTDGGITSFVRTVLCEGGVPQRPVIFVTRKKLVHAIQQKLWKLNGEPGWVTIYGMAGCGKSVLAAEAVRDHSLLEGCFSGGVHWVSIGKQDKSGLLMKLQNLCMRLDQEESFSQRLPLNIEEAKDRLRVLMLRKHPRSLLILDDVWDPWVLKAFDNQCQILLTTRDKSVTDSVMGPKHVVPVESGLGREKGLEILSLFVNMKKEDLPAEAHSIIKECKGSPLVVSLIGALLRDFPNRWAYYLRQLQNKQFKRIRKSSSYDYEALDEAMSISVEMLREDIKDYYTDLSILQKDVKVPTKVLCVLWDLETEEVEDILQEFVNKSLLFCNRNGKSFCYYLHDLQVDFLTEKNRSQLQDLHRKMVTQFQRYYQPHTLSPDQEDCMYWYNFLAYHMASANMHKELCALMFSLDWIKAKTELVGPAHLIHEFVAYRHILDEKDCAVCENFQEFLSLNGHLLGRQPFPNIVQLGLCEPETSEVYRQAKLQAKQEGDTGRLYLEWINKKTIKNLSRLVVRPHTDAVYHACFSQDGQRIASCGADKTLQVFKAETGEKLLDIKAHEDEVLCCAFSSDDSYIATCSADKKVKIWDSATGKLVHTYDEHSEQVNCCHFTNKSNHLLLATGSNDFFLKLWDLNQKECRNTMFGHTNSVNHCRFSPDDELLASCSADGTLRLWDVRSANERKSINVKRFFLSSEDPPEDVEVIVKCCSWSADGDKIIVAAKNKVLLFDIHTSGLLAEIHTGHHSTIQYCDFSPYDHLAVIALSQYCVELWNIDSRLKVADCRGHLSWVHGVMFSPDGSSFLTASDDQTIRVWETKKVCKNSAIVLKQEIDVVFQENETMVLAVDNIRGLQLIAGKTGQIDYLPEAQVSCCCLSPHLEYVAFGDEDGAIKIIELPNNRVFSSGVGHKKAVRHIQFTADGKTLISSSEDSVIQVWNWQTGDYVFLQAHQETVKDFRLLQDSRLLSWSFDGTVKVWNVITGRIERDFTCHQGTVLSCAISSDATKFSSTSADKTAKIWSFDLLSPLHELKGHNGCVRCSAFSLDGILLATGDDNGEIRIWNVSDGQLLHSCAPISVEEGTATHGGWVTDVCFSPDSKTLVSAGGYLKWWNVATGDSSQTFYTNGTNLKKIHVSPDFRTYVTVDNLGILYILQVLE

SEQ ID NO: 517 - protein, 1238 aa, Mus musculus
MDAKARNCLLQHREALEKDIKTSYIMDHMISNGVLSVIEEEKVKSQATQYQRAAALIKMILNKDNCAYISFYNALLHEGYKDLAALLQSGLPLVSSSSARTVLCEGGVPQRPVIFVTRKKLVHAIQQKLWKLNGEPGWVTIYGMAGCGKSVLAAEAVRDHSLLEGCFSGGVHWVSIGKQDKSGLLMKLQNLCMRLDQEESFSQRLPLNIEEAKDRLRVLMLRKHPRSLLILDDVWDPWVLKAFDNQCQILLTTRDKSVTDSVMGPKHVVPVESGLGREKGLEILSLFVNMKKEDLPAEAHSIIKECKGSPLVVSLIGALLRDFPNRWAYYLRQLQNKQFKRIRKSSSYDYEALDEAMSISVEMLREDIKDYYTDLSILQKDVKVPTKVLCVLWDLETEEVEDILQEFVNKSLLFCNRNGKSFCYYLHDLQVDFLTEKNRSQLQDLHRKMVTQFQRYYQPHTLSPDQEDCMYWYNFLAYHMASANMHKELCALMFSLDWIKAKTELVGPAHLIHEFVAYRHILDEKDCAVCENFQEFLSLNGHLLGRQPFPNIVQLGLCEPETSEVYRQAKLQAKQEGDTGRLYLEWINKKTIKNLSRLVVRPHTDAVYHACFSQDGQRIASCGADKTLQVFKAETGEKLLDIKAHEDEVLCCAFSSDDSYIATCSADKKVKIWDSATGKLVHTYDEHSEQVNCCHFTNKSNHLLLATGSNDFFLKLWDLNQKECRNTMFGHTNSVNHCRFSPDDELLASCSADGTLRLWDVRSANERKSINVKRFFLSSEDPPEDVEVIVKCCSWSADGDKIIVAAKNKVLLFDIHTSGLLAEIHTGHHSTIQYCDFSPYDHLAVIALSQYCVELWNIDSRLKVADCRGHLSWVHGVMFSPDGSSFLTASDDQTIRVWETKKVCKNSAIVLKQEIDVVFQENETMVLAVDNIRGLQLIAGKTGQIDYLPEAQVSCCCLSPHLEYVAFGDEDGAIKIIELPNNRVFSSGVGHKKAVRHIQFTADGKTLISSSEDSVIQVWNWQTGDYVFLQAHQETVKDFRLLQDSRLLSWSFDGTVKVWNVITGRIERDFTCHQGTVLSCAISSDATKFSSTSADKTAKIWSFDLLSPLHELKGHNGCVRCSAFSLDGILLATGDDNGEIRIWNVSDGQLLHSCAPISVEEGTATHGGWVTDVCFSPDSKTLVSAGGYLKWWNVATGDSSQTFYTNGTNLKKIHVSPDFRTYVTVDNLGILYILQVLE

SEQ ID NO: 518 - protein, 192 aa, Cavia porcellus
MQAIKCVVVGDGAVGKTCLLISYTTNAFPGEYIPTVFDNYSANVMVDSKPVNLGLWDTAGQEDYDRLRPLSYPQTDVFLICFSLVSPASYENVHANWYPKVRHHCPSTPIILLGTKLDLRDDKETIEKLKEKKLAPITYPQGLALAKEIDSVKYLECSALTQRGLKTVFDEAIRAVLCPQPTRPQKRACSLL

SEQ ID NO: 519 - protein, 375 aa, Mus musculus
MDAIHLGMSSAPLVKHTNGVGLKAHRPRVMSKSGHSNVRIDKVDGIYLLYLQDLWTTVIDMKWRYKLTLFAATFVMTWFLFGVVYYAIAFIHGDLQLGESNSNHTPCIMKVDSLTGAFLFSLESQTTIGYGVRSITEECPHAIFLLVAQLVITTLIEIFITGTFLAKIARPKKRAETIKFSHCAVISKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQKLEEQYRQEDQRERELRSLLLQQSNV

SEQ ID NO: 520 - protein, 334 aa, Rattus norvegicus
MSEPIRVLVTGAAGQIAYSLLYSIGNGSVFGKDQPIILVLLDITPMMGVLDGVLMELQDCALPLLQDVIATDKEEVAFKDLDVAVLVGSMPRREGMERKDLLKANVKIFKSQGAALEKYAKKSVKVIVVGNPANTNCLTASKSAPSIPKENFSCLTRLDHNRAKSQIALKLGVTADDVKNVIIWGNHSSTQYPDVNHAKVKLQGKEVGVYEALKDDSWLKGEFITTVQQRGAAVIKARKLSSAMSAAKAISDHIRDIWFGTPEGEFVSMGVISDGNSYGVPDDLLYSFPVVIKNKTWKFVEGLPINDFSREKMDLTAKELTEEKETAFEFLSSA

SEQ ID NO: 521 - protein, 144 aa, Mus musculus
MWLAILLALCCLTSDTHGARPPDFCSKDLISSVKPGFPKTIETNNPGVLKAARHSVEKFNNCTNDIFLFKESHVSKALVQVVKGLKYMLEVKIGRTTCRKTMHHQLDNCDFQTNPALKRTLYCYSEVWVIPWLHSFEVPVLLCQ

SEQ ID NO: 522 - protein, 84 aa, Mus musculus
DTLWLIPITFLTIGYGDVVPGTMWGKIVCLCTGVMGVCCTALLVAVVARKLEFNKAEKHVHNFMMDIHYAKEMKESAARLLQEA

SEQ ID NO: 523 - protein, 30 aa, Mus musculus
KWVLYLLLVKCLITLSTAFLLCLIVVFHAK

SEQ ID NO: 524 - protein, 232 aa, Acipenser transmontanus
MQKVKVLQVCAWVLLLWRCWGVLGYPLDCKDEQGSIISCTSISLEKLLDRVIQHAELIYHVSEESCTLFEEMFVPVSMRTQQNRARNTCITKAFPIPGSKSEIQKISDKWLLHSVLMLVQSWIEPLVYLQKTLDRYDDAPDTILNKTKWVTNKLSSLEQGIVELIRKMLDEGLLAVDHQQTLTRFDVQPEVVESILRDYAVLTCFKKDAHKMEVFLKLLKCRHTDKMSCYIS

SEQ ID NO: 525 - protein, 433 aa, Xenopus laevis
MSDKLSYKVADISLADWGRKAIEIAENEMPGLMKMREMYSESKPLKGARIAGCLHMTLQTAVLIETLTAIGAEVQWSSCNIFSTQDHAAAAIAKTGVPVYAWKGETDEEYIWCIEQTIYFKDGKPLNMILDDGGDLTNLVHTKYPQLLKGIKGISEETTTGVHNLYKMKSSGTLQVPAINVNDSVTKSKFDNLYGCRESLIDGIKRATDVMIAGKVAVVAGYGDVGKGCAQALRAFGARVLITEIDPINALQAAMEGYEVTTMDEASKEGNIFVTTTGCADIVEGRHFENMKDDSIVCNIGHFDVELDVKWLNDNAAKKINIKPQVDRYLLKNGRHIILLAEGRLVNLGCAMGHPSFVMSNSFTNQVMAQIELWTNTDKYPVGVYFLPKKLDEAVAAAHLDKLGVKLTKLTDKQAKYLGLDKEGPFKPDHYRY

SEQ ID NO: 526 - protein, 495 aa, Methanosarcina barkeri
  MOD_RES (334)..(334): Pyrrolysine
MAKNNAVAGFNALNGVELNLFTTDELKAIHYATMEVLMDPGIQVSDPEARQIFKENGCEVNEKTNVVKIPEYLVRKALQLAPSRFVLWGRDKKFNTVQECGGKVHWTCFGTGVKVCKYQDGKYVTVDSVEKDIADIAKLCDWAENIDYFSLPVSARDIAGQGAQDVHETLTPLANTAKHFHHIDPVGENVEYYRDIVKAYYGGDEEEARKKPIFSMLLCPTSPLELSVNACQVIIKGARFGIPVNVLSMAMSGGSSPVYLAGTLVTHNAEVLSGIVLAQLTVPGAKVWYGSSTTTFDLKKGTAPVGSPELGLISAAVAKLAQFYGLPSYVAGSKSDAKVPDDQAGHEKTMTTLLPALAGANTIYGAGMLELGMTFSMEQLVIDNDIFSMVKKAMQGIPVSEETLAVESIQKVGIGNNFLALKQTRQLVDYPSNPMLLDRHMFGDWAAAGSKDLATVAHEKVEDVLKNHQVTPIDADIFKDMQAIVDKADKAFRGM

SEQ ID NO: 527 - protein, 104 aa, Candida albicans
VIDLIEMRPTSIEKETFPILVEQKQLYSFDLEGYWMDVGQPKDFLSGTCLYLTSLSKKHPEKLCKEKYVHGGNVLIDPTAKIHPSALIGPNVTIGPNVVVGEGA

SEQ ID NO: 528 - protein, 69 aa, Candida albicans
LEGYWMDVGQPKDFLSGTCLYLTSLSKKHPEKLCKEKYVHGGNVLIDPTAKIHPSALIGPNVTIGPNVV

SEQ ID NO: 529 - protein, 344 aa, Schizophyllum commune
MSSYKLFCMGNPLLDLQVRDGEKLLEKYGLKSNDAILAEEKHLLLYDEIVKEHEVTYVAGGAAQNAARGAAYCLPPKSVVYTGCVGDDDLAEQLKAANKREGLDEAYLVKKGEKTGACAVIITGHDRSLVTTLRAAEKFEQSHLSSEAVAPLVDAVQFYYMEGYFVTHGLASALELAGKSAAKSKCFVLNFSAPFIPQFFMPAIQQLLPYVDIVIANESEAEAWASASGHPAPTDLAAVAKSLAMQPKTNPARPRVVIFTHGAEETVVVNSAEPGRVRTFKVDKLAEGEIVDTNGAGDAFAGGFLGALVAGRELDDSVEAGHKLAKISIQQIGPQFKWPKVQIL

SEQ ID NO: 530 - protein, 348 aa, Candida albicans
MSVPTTQKAVIFETNGGKLEYKDIPVPKPKANELLINVKYSGVCHTDLHAWKGDWPLATKLPLVGGHEGAGVVVALGENVKGWKVGDYAGVKWLNGSCLNCEYCQSGAEPNCAEADLSGYTHDGSFQQYATADAVQAARIPAGTDLANVAPILCAGVTVYKALKTAELEAGQWVAISGAAGGLGSLAVQYAKAMGYRVLAIDGGEDKGEFVKSLGAETFIDFTKEKDVVEAVKKATNGGPHGVINVSVSERAIGQSTEYVRTLGKVVLVGLPAGAKISTPVFDAVIKTIQIKGSYVGNRKDTAEAVDFFTRGLIKCPIKIVGLSELPEVYKLMEEGKILGRYVLDNDK

SEQ ID NO: 531 - protein, 416 aa, Agaricus bisporus
MSLSNKLSITDLALTGKRVLIRVDFNSPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPRRASGFLVKKELDYFAKALENPERPFLAILGGAKVSDKIQLIENMLDKVNCLVIGGGMAFTFKKTMQNVAIGNSLFDKPGSEKVAGIVEKAKKNNVEIVFPVDYVVGDKFDANANHKIVTDDEGVPDGWMGLDVGPKSNELFREAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 532 - protein, 506 aa, Schizosaccharomyces pombe
MISTCITVAGSDCSGGAGVQADLKVFTAHSVYGMSAVTAITSQNTIGVNGVHLIPASYVEQQISACLLDVHCEVMKTGMLFNQQILKVIVESIDRFKIKKVVVDPLIATRKGALLVMPDYLELFVKELIPRAEVLIPNIAEALIILKHMTNEFVEIHHLEDVKAVGKKLIKAGCKNVVIRCDDIPFASDFFCSRETNMPPTWYLYVLCTSEGEVLLPQKWLASKTARGTSCALSSAVASNLAIGLDLVTATQNAVSYTQRALEMSFHLGRGANSLDYASALTRLPYEKGEFINFVRYHPSITPKWLSIVNHPFVEQLKAGTLSRLPFQKYLVLKYHMLINNAQAAGMMAFSSSSISAIEHSAKIIQAIKEENVTHLRICEQYGLSASQITKSKPEIVKSHSLFIHDTAQQDGLRGIQIAMLPFVFMIQEVVSQISASDGYPYVAWVEHCKDKSATSHIETLLESLETNSQIISLSKVQHLLGILEKSLDFERLVLDTSSSNESSVF

SEQ ID NO: 533 - protein, 104 aa, Schizosaccharomyces pombe
ILKHMTNEFVEIHHLEDVKAVGKKLIKAGCKNVVIRCDDIPFASDFFCSRETNMPPTWYLYVLCTSEGEVLLPQKWLASKTARGTSCALSSAVASNLAIGLDLV

SEQ ID NO: 534 - protein, 173 aa, Schizosaccharomyces pombe
KIKKVVVDPLIATRKGALLVMPDYLELFVKELIPRAEVLIPNIAEALIILKHMTNEFVEIHHLEDVKAVGKKLIKAGCKNVVIRCDDIPFASDFFCSRETNMPPTWYLYVLCTSEGEVLLPQKWLASKTARGTSCALSSAVASNLAIGLDLVTATQNAVSYTQRALEMSFHLG

SEQ ID NO: 535 - protein, 176 aa, Schizosaccharomyces pombe
LKVRNFGGAKHIVYFNKLIINTIFDSVDGLTSKDATFAKQVEKKESLKNFWESLWKFFTHFFIVLPTWPVHDKDNLVDLMRDTLDFCDMLINIFEEVNGFIFGLSDNDIKIVSANDKGSALAMCIADSLVTVSYWLKLTDSSLLTSVVKVICKMLKICKKLECPISQNVIDIIHRA

SEQ ID NO: 536 - protein, 116 aa, Schizosaccharomyces pombe
THFFIVLPTWPVHDKDNLVDLMRDTLDFCDMLINIFEEVNGFIFGLSDNDIKIVSANDKGSALAMCIADSLVTVSYWLKLTDSSLLTSVVKVICKMLKICKKLECPISQNVIDIIH

SEQ ID NO: 537 - protein, 278 aa, Schizosaccharomyces pombe
MSKANISSKLKKVVESIYNPKLADSWDNTGLLLEAPFPRTNASSVLLTIDLTEKVAEEAISNKLVSSIVAYHPIIFRGLKAITMEDPQQRSLLKLAAEGIHVYSPHTAVDAAVDGVNDWLAQGIAGGRNNIKSVVPTQQNSVMAEAEGYGRICELKIPTTLRELVQRAKELTGLQYVQVCAPNGLDSHISKVSLCAGSGGSVVMNTDADLYFTGELSHHQVLAAMAKGISVILCGHSNTERGYLKDVMCQKLASSFHKEGVDANVIVSSMDADPLTTM

SEQ ID NO: 538 - protein, 61 aa, Schizosaccharomyces pombe
LSHLTSRLLKFWDEYVVPLQGKKKCVIVLCHGGVINVLRTHFMEEKGFTFDKSKLESKIIT

SEQ ID NO: 539 - protein, 146 aa, Schizosaccharomyces pombe
ILQGSVDTNLNETGRLQAKLLAQRLLPLDIDQIFCSSMKRCRETIAPYLELKPEVPIVYTDLIRERVYGDLEGMNVVEAKKLLNANHPDHYGEGLSHLTSRLLKFWDEYVVPLQGKKKCVIVLCHGGVINVLRTHFMEEKGFTFDK

SEQ ID NO: 540 - protein, 1047 aa, Schizosaccharomyces pombe
MSAKSENKQSVKALEELLKHLTVCDAAEEADAAKALASFVNGPIEEQDAPSQVFSAISKQLNDKNATARERVLKGLEAVANHGSVAADVEPYLVELLPAVIAKVADKQNAVRDAAIAASKAIVRCTTPYAVKAIVPSVLESIHTTGKWNEKMNSLQLLDVLVEVAPSQLSYSLPQIIPVVSESMWDTKAEVKKQSKETMTKVCTLIANADIDRFIPELINCIAHPEEVPETIHSLGATTFVTEVQAPTLSIMVPLLARGLNERSTPIKRKTAVIIDNMSKLVEDPQVVAPFLPKLLPGLYHIKDTIGDPECRSVVQRAITTLERVGNVVDGKIPEVSTAANPEVCLETLKAVLGEIKVPTNEEVIAKYVANIAAQLVEEKDNENESWVLNITPYLTAFIDEAHIHKIVEQLRTRSIAKIPGGASHAEEEEEGEDLCNCEFSLAYGAKILLNRTRLRLKRGRRYGLCGPNGSGKSTLMRAIVNGQVEGFPTHLRTVYVEHDIDESEADTPSVDFILQDPAVPIKDRDEIVKALKENSFTDELINMPIGSLSGGWKMKLALTRAMFKNPDILLLDEPTNHLDVVNVAWLENFLVNQKDVSSIIVSHDSGFLDHVVQAIIHYERFKLRKYLGNMSEFVKKVPSAKSYYELGASEMEFKFPEPGFLEGVKTKQRAIIKVQHMSFQYPGTSKPQLNDISFQVSLSSRIAVIGPNGAGKSTLIKVLTGELLPTVGEIYQHENCRIAYVAQAAFTHLGHHPDKTPSEYIQWRFQSGEDLEAMDKASRVISEADEEAMKNKIFKIEGTQRKILGIHSRRKLKNSYEYECSFLVGENIGMKSERWVPMMSSDNAWLPRGELMETHAKMVAEVDRAEALKSGQFRPLVRKEIEEHCSLLGLDAELVSHSRIKGLSGGQKVKLVLAACTWLRPHVIVLDEPTNYLDRDSLGALSKGLKNFGGGVVLVTHSREFTEGLTEEVWAVNNGHMTPSGHNWVSGQGSGPRIQEKEEGDTFDAFGNKIEKAKKAKKLTGAELRKKKKERMARRKAGLEVSDDEL

SEQ ID NO: 541 - protein, 535 aa, Schizosaccharomyces pombe
MLSLLNPKAESIQRAQALQVNISAAIGLQDVLKSNLGPTGTTKMLVDGAGAIKLTKDGKVLLTEMQIQNPTASCIAKAATAQDDATGDGTTSVCLLVGELLKQAELYIREGLHPSLISDGFNLAKNEALTFLDSFKTDFEVDREVLLNVAKTSLSTKISSKVVESLAPAVVDAILTIRRPDEPIDLHMVEIMKMQNRSASDTQLIRGLLLDHGARHPDMPKQVKNAYILILNVSLEYEKSEINSGFFYSTSEQRERLVESERKFVDNKLRKIVELKKEVCERDPTANFVIINQKGIDPLSLDVLAKNGIMALRRAKRRNMERLQLACGGVAQNSVDDLNPEVLGWAGSVYERTLGEEKYTFVEDVKDPKSATILIHGPNTYTIQQIQDATRDGLRAVKNAVEDNCLIVGAGAFEVACAAHLRNKFAAKEVKGKAKMGVYAYADALLIIPKTLAANSSYDTQDAIVALQEEASEGYKVGLDLKTGMPFDPEVEGIYDNYRVIRHMLHSATVIASNLISVDQILRAGRSSLKEGPPQ

SEQ ID NO: 542 - protein, 137 aa, Schizosaccharomyces pombe
PLEFAIVKLDHGIILTVCGSSKKIMVYGSDSAISSFKLKAVLRGHLDWVRTLSFKKTSGSTATLASGSQDRYIRLWNISLWGSEDEKVSEEFFESVLSNKPVRFTLGKIDLKIVFDALLMGHEDWVMSVDWHPTKEM

SEQ ID NO: 543 - protein, 32 aa, Schizosaccharomyces pombe
FTLGKIDLKIVFDALLMGHEDWVMSVDWHPTK

SEQ ID NO: 544 - protein, 346 aa, Schizosaccharomyces pombe
MALRYVVHDEISGFDQLKPEEYEVPQKLNPGEVLVKLKAASLNYRDLIITKGLYPLPLQLPVVPGSDGAGIIEKVGEDVEGFEKGDSVVCNFFTNYLDGTPTDFATHSALGGTRDGCFQKYAVLPAHALVHAPKNLSFEEIATLPCAAVTAWNGLFGSKEHQVKPGNNVLVLGTGGVSTFALQFALAAGANVTVTSSSDEKLEFAKKLGATHTINYKKTPQWASPALKMTNGVGYHHVIEVGGEKTLPQSIACLAKDGMISMIGFVASEGTTPNLTSIIGQILNRNANIRGIFVGSVSMFRDMVACIEAKDIHPVVDKVFPFDQLKEAYEYQWSQAHIGKVVLKID

SEQ ID NO: 545 - protein, 84 aa, Schizosaccharomyces pombe
HKKRLNTMVYFLREWSIQPKLDHPNILKVICPCVTLTSVFNKSAGFCLVQEYCPQGDLFKQIEEKVLTLEDKCCYLKQILQAVA

SEQ ID NO: 546 - protein, 32 aa, Schizosaccharomyces pombe
FLREWSIQPKLDHPNILKVICPCVTLTSVFNK

SEQ ID NO: 547 - protein, 425 aa, Schizosaccharomyces pombe
MSTIEAIYLVDTNGALLLQLESRGRTSPITLEHIKNELFRYKLRNEEPPFILHNKNFLIFQELEEDVRLCIPTTCDTEPLYIHDIMRRIVDVVKTFFGGFNASKVEKNVCVIVQLLAEMIDYGYATCMEPNALQDIVPLPSFMNKFMAVTGLQTNTPTLARDTVPWRTAKAKYATNEFFIHVLERVSAVYQPNGKLAFGTVKSDMECKCQISGMPLLLLSLRPGTKLGNVRFHQSVNLKRWKQHPDQIEFIPPDGKFTLASFQTDFATQKSLPVVVEAKNKLDGRFEVRIRNTGKKSVENLKILITIPQALKSVTVTEGNYIFRASKYTHMEEGILEWSVKKLAWTSPALVLTGFLAPLKKDANSTEESSSYSKLEHLDLQYKLQGSTLHNFKVESLKMLNHPDKKSYKGVKHTIIAQNVSFRFR

SEQ ID NO: 548 - protein, 563 aa, Schizosaccharomyces pombe
MSKSQEQRLQNFVTVIQGLNDILDDKMDEATEKFKSGNSSFHLSGQAVVAFIQAVLTFEPSRFKDSQNRIDIAIKALSADKDDASKNNTFLSTFDPGVEYRVSIGLMLLLSALIGFCSESIVTSVKSVYKLRKAHSIFSKINKRHFDHFSAAFHSTGRSDVDLANEYVQTGTLLCTGLFTLLISLLPPKMITILNVFGYKGDRDWALQCMWMPALQRPTSFFAAVAFAALIQYYSGAVQLCSIYKKTPEEPDGWPDKRCFEILEKVEKAHPDGPMWPLHRAKLLSMVKKQDEAIVVLEELMAKPPPRLKQLEVLIVFEHALDCAFSHRYVDGANSFLKLSSLNDSSTALYSYFAAACFLQDVHVNANVEALEKASKLLEPLHDLVANKTAPLDVHIRRKVGKLIKRRASAGNQGGLAEYVGFSPLYELVYVWNGFRRMTDDELSKFDVERMEPWQDQDDDICQALIKATVLRNLGRTDEVFPILQKICAVTRTTETWAVAFAHYEMAVAFFESNGSKKEGLKHCDAYLRKARDFGGDNEFESRLIIRVQLARHVVRKCLQSMS

SEQ ID NO: 549 - protein, 412 aa, Schizosaccharomyces pombe
MLCLVYNSILCKQRRISLKVLQQFRCWNISKTFLSYRTLTALAIETSCDDTSVSVVRTSDSSSHCQNEIICLNTHRTISKYEAYGGIHPTIVIHEHQKNLAKVIQRTISDAARSGITDFDLIAVTRGPGMIGPLAVGLNTAKGLAVGLQKPLLAVHHMQAHALAVQLEKSIDFPYLNILVSGGHTMLVYSNSLLNHEIIVTTSDIAVGDYLDKCAKYLGIPWDNEMPAAALEQFASPEINSTSYSLKPPIPLNTREKVHSASFSFSGLESYACRIIRKTPLNLSEKKFFAYQLQYAAFQHICQKTLLALKRLDLSKVKYLVCSGGVARNELLKKMLNDTLMVLQFEHQPTDIKLVYPSPDICSDNAAMIGYTAIQMFKAGYTSSFDVEPIRKWPINQILTVEGWLTKKNKKV

SEQ ID NO: 550 - protein, 98 aa, Drosophila melanogaster
KDSILTPSKLHLEYGYLQHKPFYRQTWFMVSLAATSIVIIVMVIAVLCVKSKSYKYKQEAQKTLEESMAMSIDERQELALELYRSRHGVGTGTLNSVG

SEQ ID NO: 551 - protein, 48 aa, Drosophila melanogaster
LTPSKLHLEYGYLQHKPFYRQTWFMVSLAATSIVIIVMVIAVLCVKSK

SEQ ID NO: 552 - protein, 236 aa, Chlorocebus aethiops
MGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLAALTTSVLKNNLCPSGSNIISNLLKKDCHQKIDELFSGKLYLIGIAAIVVAVIMIFEMILSMVLCCGIRNSSVY

SEQ ID NO: 553 - protein, 330 aa, Bos taurus
MATGQKLMRAIRVFEFGGPEVLKLQSDVAVPIPKDHQVLIKVQACGVNPVDTYIRSGTHNIKPLLPYTPGFDVAGIIEAVGESVSAFKKGDRVFTTRTISGGYAEYALAADHTVYTLPEKLDFKQGAAIGIPYFTAYRALLHSACVKPGESVLVHGASGGVGIAACQIARAYGLKVLGTASTEEGQKIVLENGAHKVFNHKEADYIDKIKKSVGEKGVDVIIEMLANVNLSNDLNLLSHGGRVIVVGSRGTIEINPRDTMTKESSIKGVTLFSSTKEEFQQFAAALQAGMEIGWLRPVIGPQYLLEKATQAHENIIHSSGATGKMILLLN

SEQ ID NO: 554 - protein, 132 aa, Canis familiaris
IIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTVGGPTLVI

SEQ ID NO: 555 - protein, 33 aa, Bos taurus
WSFIGPVTFIILLNIIFLVITLCKMVKHSNTLK

SEQ ID NO: 556 - protein, 36 aa, Bos taurus
IFLVITLCKMVKHSNTLKPDSSRLENIKSWVLGAFA

SEQ ID NO: 557 - protein, 48 aa, Bos taurus
EKACWLHVDNYFIWSFIGPVTFIILLNIIFLVITLCKMVKHSNTLKPD

SEQ ID NO: 558 - protein, 33 aa, Bos taurus; identical to SEQ ID NO: 555

SEQ ID NO: 559 - protein, 33 aa, Bos taurus; identical to SEQ ID NO: 555

SEQ ID NO: 560 - protein, 36 aa, Bos taurus; identical to SEQ ID NO: 556

SEQ ID NO: 561 - protein, 48 aa, Bos taurus; identical to SEQ ID NO: 557

SEQ ID NO: 562 - protein, 33 aa, Bos taurus; identical to SEQ ID NO: 555

SEQ ID NO: 563 - protein, 529 aa, Macaca fascicularis
MSVKWTSVILLIQLSFYFSSGSCGKVLVWAAEYSHWMNMKTILEELVQRGHEVTVLASSASILFDPNNSSALKIEVFPTSLTKTEFENIIRQQIKRWSELPKDTFWLYFSQMQEIMWKFGDITRNFCKDVVSNKKLMKKLQKSRFDVVFADAIFPCSELLAELLNTPLVYSLRFTPGYNFEKHCGGFLFPPSYVPVVMSELSDHMTFMERVKNMIYMLYFDFCFQIYAMKKWDQFYSEVLGRPTTLSETMGKADIWLIRNSWNFQFPHPLLPNVDFVGGLHCKPAKPLPKEMEEFVQSSGENGVVVFSLGSMVTNMKEERANVIASALAQIPQKVLWRFDGKKPDTLGLNTRLYKWIPQNDLLGHPKTRAFITHGGSNGIYEAIYHGVPMVGIPLFADQPDNIAHMKAKGAAVRLDFDTMSSTDLVNALKTVINDPLYKENVMKLSRIQHDQPVKPLDRAVFWIEFVMRHKGAKHLRPAAHDLTWFQYHSLDVIGFLLACVATVIFIIMKCCLFCFWKFARKGKKGKSD

SEQ ID NO: 564 - protein, 487 aa, Oryctolagus cuniculus
MDPVVVLVLGLCCLLLLSIWKQNSGRGKLPPGPTPFPIIGNILQIDAKDISKSLTKFSECYGPVFTVYLGMKPTVVLHGYEAVKEALVDLGEEFAGRGSVPILEKVSKGLGIAFSNAKTWKEMRRFSLMTLRNFGMGKRSIEDRIQEEARCLVEELRKTNASPCDPTFILGCAPCNVICSVIFHNRFDYKDEEFLKLMESLNENVRILSSPWLQVYNNFPALLDYFPGIHKTLLKNADYIKNFIMEKVKEHQKLLDVNNPRDFIDCFLIKMEQENNLEFTLESLVIAVSDLFGAGTETTSTTLRYSLLLLLKHPEVAARVQEEIERVIGRHRSPCMQDRSRMPYTDAVIHEIQRFIDLLPTNLPHAVTRDVRFRNYFIPKGTDIITSLTSVLHDEKAFPNPKVFDPGHFLDESGNFKKSDYFMPFSAGKRMCVGEGLARMELFLFLTSILQNFKLQSLVEPKDLDITAVVNGFVSVPPSYQLCFIPI

SEQ ID NO: 565 - protein, 333 aa, Gallus gallus
MATLKEKLITPVAAGSTVPSNKITVVGVGQVGMACAISILGKGLCDELALVDVLEDKLKGEMMDLQHGSLFLQTHKIVADKDYAVTANSKIVVVTAGVRQQEGESRLNLVQRNVNVFKFIIPQIVKYSPNCTILVVSNPVDILTYVTWKLSGLPKHRVIGSGCNLDTARFRYLMAERLGIHPTSCHGWILGEHGDSSVAVWSGVNVAGVSLQELNPAMGTDKDSENWKEVHKQVVESAYEVIRLKGYTNWAIGLSVAELCETMLKNLYRVHSVSTLVKGTYGIENDVFLSLPCVLSASGLTSVINQKLKDDEVAQLKKSADTLWSIQKDLKDL

SEQ ID NO: 566 - protein, 332 aa, Sus scrofa
MATLKDQLIHNLLKEEHVPHNKITVVGVGAVGMACAISILMKELADEIALVDVMEDKLKGEMMDLQHGSLFLRTPKIVSGKDYNVTANSRLVVITAGARQQEGESRLNLVQRNVNIFKFIIPNIVKYSPNCKLLVVSNPVDILTYVAWKISGFPKNRVIGSGCNLDSARFRYLMGERLGVHPLSCHGWILGEHGDSSVPVWSGVNVAGVSLKNLHPELGTDADKEHWKAVHKQVVDSAYEVIKLKGYTSWAIGLSVADLAESIMKNLRRVHPISTMIKGLYGIKEDVFLSVPCILGQNGISDVVKVTLTPEEEAHLKKSADTLWGIQKELQF

SEQ ID NO: 567 - protein, 333 aa, Squalus acanthias
MATLKDKLIGHLATSQEPRSYNKITVVGVGAVGMACAISILMKDLADEVALVDVMEDKLKGEMMDLQHGSLFLHTAKIVSGKDYSVSAGSKLVVITAGARQQEGESRLNLVQRNVNIFKFIIPDIVKHSPDCIILVVSNPVDVLTYVAWKLSGLPMHRIIGSGCNLDSARFRYLMGERLGVHSSSCHGWVIGEHGDSSVPVWSGMNVAGVSLKELHPELGTDKDKENWKKLHKDVVDSAYEVIKLKGYTSWAIGLSVADLAETIMKNLCRVHPVSTMVKDFYGIKNDVFLSLPCVLDNHGISNIVKMKLKPDEEQQLQKSATTLWDIQKDLKF

SEQ ID NO: 568 - protein, 332 aa, Mus musculus
MSTVKEQLIQNLVPEDKLSRCKITVVGVGNVGMACAISILLKGLADELALVDADTNKLRGEALDLLHGSLFLSTPKIVFGKDYNVSANSKLVIITAGARMVSGETRLDLLQRNVAIMKAIVPGIVQNSPDCKIIIVTNPVDILTYVVWKISGFPVGRVIGSGCNLDSARFRYLIGEKLGVNPTSCHGWVLGEHGDSSVPIWSGVNVAGVTLKSLNPAIGTDSDKEHWKNVHKQVVEGGYEVLNMKGYTSWAIGLSVTDLARSILKNLKRVHPVTTLVKGFHGIKEEVFLSIPCVLGQSGITDFVKVNMTAEEEGLLKKSADTLWNMQKDLQL

SEQ ID NO: 569 - protein, 338 aa, Sus scrofa
  MOD_RES (21)..(21): Any amino acid
MLSALARPAGAALRRSFSTSXQNNAKVAVLGASGGIGQPLSLLLKNSPLVSRLTLYDIAHTPGVAADLSHIETRATVKGYLGPEQLPDCLKGCDVVVIPAGVPRKPGMTRDDLFNTNATIVATLTAACAQHCPDAMICIISNPVNSTIPITAEVFKKHGVYNPNKIFGVTTLDIVRANAFVAELKGLDPARVSVPVIGGHAGKTIIPLISQCTPKVDFPQDQLSTLTGRIQEAGTEVVKAKAGAGSATLSMAYAGARFVFSLVDAMNGKEGVVECSFVKSQETDCPYFSTPLLLGKKGIEKNLGIGKISPFEEKMIAEAIPELKASIKKGEEFVKNMK

SEQ ID NO: 570 - protein, 314 aa, Sus scrofa
MAFATRQLVRSLSSSSTAAASAKKILVKHVTVIGGGLMGAGIAQVAAATGHTVVLVDQTEDILAKSKKGIEESLRKVAKKKFAENPKAGDEFVEKTLSSISTSTDAASVVHSTDLVVEAIVENLKVKSELFKRLDKFAAEHTIFASNTSSLQITSLANATTRQDRFAGLHFFNPVPLMKLVEVVKTPMTSQKTLESLVDFSKTLGKHPVSCKDTPGFIVNRLLVPYLIEAVRLYERGDASKEDIDTAMKLGAGYPMGPFELLDYVGLDTTKFIIDGWHEMDSQNPLFQPSPAMNKLVAENKFGKKTGEGFYKYK

SEQ ID NO: 571 - protein, 387 aa, Oryctolagus cuniculus
MTRDAALPGSHSTHGFYENYEPKEILGRGVSSVVRRCIHKPTCKEYAVKIIDVTGGGSFSAEEVQELREATLKEVDILRKVSGHPNIIQLKDTYETNTFFFLVFDLMKKGELFDYLTEKVTLSEKETRKIMRALLEVICALHKLNIVHRDLKPENILLDDDMNIKLTDFGFSCQLDPGEKLREVCGTPSYLAPEIIECSMNDNHPGYGKEVDMWSTGVIMYTLLAGSPPFWHRKQMLMLRMIMSGNYQFGSPEWDDYSDTVKDLVSRFLVVQPQKRYTAEEALAHPFFQQYVVEEVRHFSPRGKFKVICLTVLASVRIYYQYRRVKPVTREIVIRDPYALRPLRRLIDAYAFRIYGHWVKKGQQQNRAALFENTPKAVLFSLAEDDY

SEQ ID NO: 572 - protein, 416 aa, Saccharomyces cerevisiae
MSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 573 - protein, 381 aa, Torpedo marmorata
MPFGNTHNKWKLNYSAAEEFPDLSKHNNHMAKALTLDIYKKLRDKETPSGFTLDDVIQTGVDNPGHPFIMTVGCVAGDEECYEVFKDLFDPVIEDRHGGYKPTDKHKTDLNQDNLKGGDDLDPNYVLSSRVRTGRSIKGIALPPHCSRGERRLVEKLCIEGLATLTGEFQGKYYPLSTMSDAEQQQLIDDHFLFDKPISPLLLASGMARDWPDGRGIWHNNDKSFLVWVNEEDHLRVISMQKGGNMKEVFRRFCVGLKKIEEIFVKAGRGFMWNEHLGYVLTCPSNLGTGLRGGVHVKIPHLCKHEKFSEVLKRTRLQKRGTGGVDTEAVGSIYDISNADRLGFSEVEQVQMVVDGVKLMVEMEKRLENGKSIDDLIPAQK

SEQ ID NO: 574 - protein, 142 aa, Bos taurus
MMSFVSLLLVGILFHATQAEQLTKCEVFRELKDLKGYGGVSLPEWVCTTFHTSGYDTQAIVQNNDSTEYGLFQINNKIWCKDDQNPHSSNICNISCDKFLDDDLTDDIMCVKKILDKVGINYWLAHKALCSEKLDQWLCEKL

SEQ ID NO: 575 - protein, 77 aa, Bos taurus
VSLLLVGILFHATQAEQLTKCEVFRELKDLKGYGGVSLPEWVCTTFHTSGYDTQAIVQNNDSTEYGLFQINNKIWCK

SEQ ID NO: 576 - protein, 259 aa, Rattus norvegicus
MWLQILSLVLSVGRIDAAPPGQSRIVGGYKCEKNSQPWQVAVINEYLCGGVLIDPSWVITAAHCYSNNYQVLLGRNNLFKDEPFAQRRLVRQSFRHPDYIPLIVTNDTEQPVHDHSNDLMLLHLSEPADITGGVKVIDLPTKEPKVGSTCLASGWGSTNPSEMVVSHDLQCVNIHLLSNEKCIETYKDNVTDVMLCAGEMEGGKDTCAGDSGGPLICDGVLQGITSGGATPCAKPKTPAIYAKLIKFTSWIKKVMKENP

SEQ ID NO: 577 - protein, 333 aa, Saccharomyces cerevisiae
METGPHYNYYKNRELSIVLAPFSGGQGKLGVEKGPKYMLKHGLQTSIEDLGWSTELEPSMDEAQFVGKLKMEKDSTTGGSSVMIDGVKAKRADLVGEATKLVYNSVSKVVQANRFPLTLGGDHSIAIGTVSAVLDKYPDAGLLWIDAHADINTIESTPSGNLHGCPVSFLMGLNKDVPHCPESLKWVPGNLSPKKIAYIGLRDVDAGEKKILKDLGIAAFSMYHVDKYGINAVIEMAMKAVHPETNGEGPIMCSYDVDGVDPLYIPATGTPVRGGLTLREGLFLVERLAESGNLIALDVVECNPDLAIHDIHVSNTISAGCAIARCALGETLL

SEQ ID NO: 578 - protein, 799 aa, Saccharomyces cerevisiae
MVLPILPLIDDLASWNSKKEYVSLVGQVLLDGSSLSNEEILQFSKEEEVPLVALSLPSGKFSDDEIIAFLNNGVSSLFIASQDAKTAEHLVEQLNVPKERVVVEENGVFSNQFMVKQKFSQDKIVSIKKLSKDMLTKEVLGEVRTDRPDGLYTTLVVDQYERCLGLVYSSKKSIAKAIDLGRGVYYSRSRNEIWIKGETSGNGQKLLQISTDCDSDALKFIVEQENVGFCHLETMSCFGEFKHGLVGLESLLKQRLQDAPEESYTRRLFNDSALLDAKIKEEAEELTEAKGKKELSWEAADLFYFALAKLVANDVSLKDVENNLNMKHLKVTRRKGDAKPKFVGQPKAEEEKLTGPIHLDVVKASDKVGVQKALSRPIQKTSEIMHLVNPIIENVRDKGNSALLEYTEKFDGVKLSNPVLNAPFPEEYFEGLTEEMKEALDLSIENVRKFHAAQLPTETLEVETQPGVLCSRFPRPIEKVGLYIPGGTAILPSTALMLGVPAQVAQCKEIVFASPPRKSDGKVSPEVVYVAEKVGASKIVLAGGAQAVAAMAYGTETIPKVDKILGPGNQFVTAAKMYVQNDTQALCSIDMPAGPSEVLVIADEDADVDFVASDLLSQAEHGIDSQVILVGVNLSEKKIQEIQDAVHNQALQLPRVDIVRKCIAHSTIVLCDGYEEALEMSNQYAPEHLILQIANANDYVKLVDNAGSVFVGAYTPESCGDYSSGTNHTLPTYGYARQYSGANTATFQKFITAQNITPEGLENIGRAVMCVAKKEGLDGHRNAVKIRMSKLGLIPKDFQ

SEQ ID NO: 579 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 580 - protein, 437 aa, Saccharomyces cerevisiae
MAVSKVYARSVYDSRGNPTVEVELTTEKGVFRSIVPSGASTGVHEALEMRDEDKSKWMGKGVMNAVNNVNNVIAAAFVKANLDVKDQKAVDDFLLSLDGTANKSKLGANAILGVSMAAARAAAAEKNVPLYQHLADLSKSKTSPYVLPVPFLNVLNGGSHAGGALALQEFMIAPTGAKTFAEAMRIGSEVYHNLKSLTKKRYGASAGNVGDEGGVAPNIQTAEEALDLIVDAIKAAGHDGKVKIGLDCASSEFFKDGKYDLDFKNPESDKSKWLTGVELADMYHSLMKRYPIVSIEDPFAEDDWEAWSHFFKTAGIQIVADDLTVTNPARIATAIEKKAADALLLKVNQIGTLSESIKAAQDSFAANWGVMVSHRSGETEDTFIADLVVGLRTGQIKTGAPARSERLAKLNQLLRIEEELGDKAVYAGENFHHGDKL

SEQ ID NO: 581 - protein, 484 aa, Saccharomyces cerevisiae
MSVHAATNPINKHVVLIDNYDSFTWNVYEYLCQEGAKVSVYRNDAITVPEIAALNPDTLLISPGPGHPKTDSGISRDCIRYFTGKIPVFGICMGQQCMFDVFGGEVAYAGEIVHGKTSPISHDNCGIFKNVPQGIAVTRYHSLAGTESSLPSCLKVTASTENGIIMGVRHKKYTVEGVQFHPESILTEEGHLMIRNILNVSGGTWEENKSSPSNSILDRIYARRKIDVNEQSKIPGFTFQDLQSNYDLGLAPPLQDFYTVLSSSHKRAVVLAEVKRASPSKGPICLKAVAAEQALKYAEAGASAISVLTEPHWFHGSLQDLVNVRKILDLKFPPKERPCVLRKEFIFSKYQILEARLAGADTVLLIVKMLSQPLLKELYSYSKDLNMEPLVEVNSKEELQRALEIGAKVVGVNNRDLHSFNVDLNTTSNLVESIPKDVLLIALSGITTRDDAEKYKKEGVHGFLVGEALMKSTDVKKFIHELCE

SEQ ID NO: 582 - protein, 334 aa, Escherichia coli
MTKPIVFSGAQPSGELTIGNYMGALRQWVNMQDDYHCIYCIVDQHAITVRQDAQKLRKATLDTLALYLACGIDPEKSTIFVQSHVPEHAQLGWALNCYTYFGELSRMTQFKDKSARYAENINAGLFDYPVLMAADILLYQTNLVPVGEDQKQHLELSRDIAQRFNALYGEIFKVPEPFIPKSGARVMSLLEPTKKMSKSDDNRNNVIGLLEDPKSVVKKIKRAVTDSDEPPVVRYDVQNKAGVSNLLDILSAVTGQSIPELEKQFEGKMYGHLKGEVADAVSGMLTELQERYHRFRNDEAFLQQVMKDGAEKASAHASRTLKAVYEAIGFVAKP

SEQ ID NO: 583 - protein, 434 aa, Drosophila melanogaster
MSHRVLVIGSGGREHAICWKLSQSPKVAQIYALPGSHGIQLVEKCRNLDAKTLDPKDFEAIAKWSKENQIALVVVGPEDPLALGLGDVLQSAGIPCFGPGKQGAQIEADKKWAKDFMLRHGIPTARYESFTDTEKAKAFIRSAPYPALVVKAAGLAAGKGVVVAANAKEACQAVDEILGDLKYGQAGATLVVEELLEGEEVSVLAFTDGKSVRAMLPAQDHKRLGNGDTGPNTGGMGAYCPCPLISQPALELVQKAVLERAVQGLIKERINYQGVLYAGLMLTRDGPRVLEFNCRFGDPETQVILPLLESDLFDVMEACCSGKLDKIPLQWRNGVSAVGVILASAGYPETSTKGCIISGLPAANTPTQLVFHSGLAVNAQKEALTNGGRVLIAIALDGSLKEAAAKATKLAGSISFSGSGAQYRTDIAQKAFKM

SEQ ID NO: 584 - protein, 409 aa, Papio anubis
LLLAGLCCLLPGSLAEDPQGDAAQKTDTPPHDQNHPTLNKITPSLAEFAFSLYRQLAHQSNSTNIFFSPVSIATAFAMLSLGTKADTHSEILEGLNFNLTEIPEAQVHEGFQELLRTLNKPDSQLQLTTGNGLFLNKSLKVVDKFLEDVKNLYHSEAFSVNFEDTEEAKKQINNYVEKGTQGKVVDLVKELDRDTVFALVNYIFFKGKWERPFEVEATEEEDFHVDQATTVKVPMMRRLGMFNIYHCEKLSSWVLLMKYLGNATAIFFLPDEGKLQHLENELTHDIITKFLENENRRSANLHLPKLAITGTYDLKTVLGHLGITKVFSNGADLSGVTEDAPLKLSKAVHKAVLTIDEKGTEAAGAMFLEAIPMSIPPEVKFNKPFVFLMIEQNTKSPLFIGKVVNPTQK

SEQ ID NO: 585 - protein, 386 aa, Gallus gallus
MGSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 586 - protein, 83 aa, Gallus gallus
VSGLEQLESIINFEKLTEWTSSNVMEERKIKVYLPRMKMEEKYNLTSVLMAMGITDVFSSSANLSGISSAESLKISQAVHAAH

SEQ ID NO: 587 - protein, 77 aa, Mus musculus
KFHYLTFLPSTDDFYDCEVDHWGLEEPLRKTWEFEEKTLLPETKENVMCALGLFVGLVGIVVGIILIMKGIKKRNVV

SEQ ID NO: 588 - protein, 75 aa, Mus musculus
HYLTFLPSTDDFYDCEVDHWGLEEPLRKTWEFEEKTLLPETKENVMCALGLFVGLVGIVVGIILIMKGIKKRNVV

SEQ ID NO: 589 - protein, 141 aa, Struthio camelus
VLSGTDKTNVKGIFSKISSHAEEYGAETLERMFITYPQTKTYFPHFDLHHGSAQIKAHGKKVANALIEAVNHIDDISGALSKLSDLHAQKLRVDPVNFKLLGQCFLVVVAIHHPSALTPEVHASLDKFLCAVGAVLTAKYR

SEQ ID NO: 590 - protein, 141 aa, Rhea americana
VLSGPDKTNVKNVFAKIGGHADAYGAETLERMFTTYPQTKTYFPHFDLHHGSAQIKTHGKKVVSALIDAANNIDDIYGALSKLSDLHAQKLRVDPVNFKLLGQCFLVVVAIHHPSLLTPEVHASLDKFLCAVGAVLTAKYR

SEQ ID NO: 591 - protein, 142 aa, Anseranas semipalmata
MVLSAADKGNVKTVFGKIGGHAEEYGAETLQRMFQTFPQTKTYFPHFDLQPGSAQIKAHGKKVAAALVEAANHIDDIAGALSKLSDLHAQKLRVDPVNFKFLGHCFLVVLAIHHPSLLTPEVHASMDKFLCAVATVLTAKYR

SEQ ID NO: 592 - protein, 142 aa, Aquila chrysaetos
MVLSANDKTNVKNVFTKISGHAEDYGAEALERMFTTYPPTKTYFPHFDLHHGSAQIKAHGKKVVGALIEAVNHIDDMAGALSKLSDLHAQKLRVDPVNFKLLGQCFLVVVAIHHPSVLTPEVHASLDKFLCAVGNVLTAKYR

SEQ ID NO: 593 - protein, 142 aa, Gallus gallus
MVLSAADKNNVKGIFTKIAGHAEEYGAETLERMFTTYPPTKTYFPHFDLSHGSAQIKGHGKKVVAALIEAANHIDDIAGTLSKLSDLHAHKLRVDPVNFKLLGQCFLVVVAIHHPAALTPEVHASLDKFLCAVGTVLTAKYR

SEQ ID NO: 594 - protein, 141 aa, Phasianus colchicus
VLSAADKNNVKGIFTKIAGHAEEYGAEALERMFITYPSTKTYFPHFDLSHGSAQIKGHGKKVVAALIEAVNHIDDITGTLSKLSDLHAHKLRVDPVNFKLLGQCFLVVVAIHHPSALTPEVHASLDKFLCAVGTVLTAKYR

SEQ ID NO: 595 - protein, 142 aa, Ara ararauna
MVLSGSDKTNVKGIFSKIGGQAEDYGAEALERMFATFPQTKTYFPHFDVSPGSAQVKAHGKKVAAALVEAANHIDDIATALSKLSDLHAQKLRVDPVNFKLLGQCFLVVVAIHNPSALTPEVHASLDKFLCAVGNVLTAKYR

SEQ ID NO: 596 - protein, 143 aa, Cyprinus carpio
MSLSDKDKAAVKGLWAKISPKADDIGAEALGRMLTVYPQTKTYFAHWADLSPGSGPVKKHGKVIMGAVGDAVSKIDDLVGGLAALSELHAFKLRVDPANFKILAHNVIVVIGMLYPGDFPPEVHMSVDKFFQNLALALSEKYR

SEQ ID NO: 597 - protein, 142 aa, Carassius auratus
SLSDKDKAVVKALWAKIGSRADEIGAEALGRMLTVYPQTKTYFSHWSDLSPGSGPVKKHGKTIMGAVGDAVSKIDDLVGALSALSELHAFKLRIDPANFKILAHNVIVVIGMLFPGDFTPEVHMSVDKFFQNLALALSEKYR

SEQ ID NO: 598 - protein, 147 aa, Mus musculus
MVHLTDAEKSAVSCLWAKVNPDEVGGEALGRLLVVYPWTQRYFDSFGDLSSASAIMGNPKVKAHGKKVITAFNEGLKNLDNLKGTFASLSELHCDKLHVDPENFRLLGNAIVIVLGHHLGKDFTPAAQAAFQKVVAGVATALAHKYH

SEQ ID NO: 599 - protein, 147 aa, Oryctolagus cuniculus
MVHFTAEEKAAITSTWKLVDVEDAGAEALGRLLVVYPWTQRFFDSFGNLSSSSAIMGNPKVKAHGKKVLTAFGDAVKNVDDLKNTFAHLSELHCDRLHVDPENFKLLGNVLVIVLAKYFGKEFTPQVQSAWQKLVAGVATALAHKYH

SEQ ID NO: 600 - protein, 147 aa, Sus scrofa
MVHFTAEEKSVITGLWGKVNVEETGGQAVGRLLVVYPWTQRFFDSFGNMSSPSAIMGNPKVKAHGKKVLTAFGDAVKNMDNLKGTFAKLSELHCDKLHVDPENFRLLGNMIVIILASHFGGEFTPEVQAAWQKLVAGVATALAHKYH

SEQ ID NO: 601 - protein, 147 aa, Capra hircus
MVHFTAEEKAAITGLWGKVNVEEAGGEALGRLLVVYPWTQRFFDSFGNLSSASAIMGNPKVKAHGKKVLTSFGEAIKNLDNLKGAFAKLSELHCDKLHVDPENFRLLGNVIVIILATHFGREFTPDVQAAWQKLVSGVATALAHKYH

SEQ ID NO: 602 - protein, 147 aa, Oryctolagus cuniculus
MVHFTPEEKCIISKQWGQVNIDETGGEALGRLLVVYPWTQRFFDNFGNLSSSSAIMGNPKVKAHGKKVLTSFGDAIKNMDNLKGAFAKLSELHCDKLHVDPENFKLLGNVLLIVLATHFGKEFTPEVQAAWQKLVSGVAIALAHKYH

SEQ ID NO: 603 - protein, 146 aa, Macropus giganteus
VHLTAEEKNAITSLWGKVAIEQTGGEALGRLLIVYPWTSRFFDHFGDLSNAKAVMANPKVLAHGAKVLVAFGDAIKNLDNLKGTFAKLSELHCDKLHVDPENFKLLGNIIVICLAEHFGKEFTIDTQVAWQKLVAGVANALAHKYH

SEQ ID NO: 604 - protein, 146 aa, Macropus rufus
VHLTAEEKNAITSLWGKVAIEQTGGEALGRLLIVYPWTSRFFDHFGDLSNAKAVMGNPKVLAHGAKVLVAFGDAIKNLDNLKGTFAKLSELHCDKLHVDPENFKLLGNIIVICLAEHFGKEFTIDTQVAWQKLVAGVANALAHKYH

SEQ ID NO: 605 - protein, 146 aa, Potorous tridactylus
VHLSSEEKGLITSLWGKIDIEQTGGEALGRLLIVYPWTSRFFDHFGDLSSAKAVLGNAKVLAHGAKVLVSFGDAIKNLDNLKGTFAKLSELHCDKLHVDPENFKLLGNVLVICLAEHFGKDFTIDAQVAWQKLVAGVANALAHKYH

SEQ ID NO: 606 - protein, 147 aa, Didelphis marsupialis
MVHLTSEEKNCITTIWSKVQVDQTGGEALGRMLVVYPWTTRFFGSFGDLSSPGAVMSNSKVQAHGAKVLTSFGEAVKHLDNLKGTYAKLSELHCDKLHVDPENFKMLGNIIVICLAEHFGKDFTPECQVAWQKLVAGVAHALAHKYH

SEQ ID NO: 607 - protein, 147 aa, Gallus gallus
MVHWTAEEKQLITGLWGKVNVAECGAEALARLLIVYPWTQRFFASFGNLSSPTAILGNPMVRAHGKKVLTSFGDAVKNLDNIKNTFSQLSELHCDKLHVDPENFRLLGDILIIVLAAHFSKDFTPECQAAWQKLVRVVAHALARKYH

SEQ ID NO: 608 - protein, 147 aa, Anas platyrhynchos
MVHWTAEEKQLITGLWGKVNVADCGAEALARLLIVYPWTQRFFASFGNLSSPTAILGNPMVRAHGKKVLTSFGDAVKNLDNIKNTFAQLSELHCDKLHVDPENFRLLGDILIIVLAAHFTKDFTPECQAAWQKLVRVVAHALARKYH

SEQ ID NO: 609 - protein, 146 aa, Ara ararauna
VHWTAEEKQLITGLWGKVNVADCGAEALARLLIVYPWTQRFFASFGNLSSPTAILGNPMVRAHGKKVLTSFGEAVKNLDNIKNTFAQLSELHCDKLHVDPENFRLLGDILIIVLAAHFGKDFTPECQAALQKLVRVVAHALARKYH

SEQ ID NO: 610 - protein, 146 aa, Ciconia ciconia
VHWTAEEKQLITGLWGKVNVDECGAEALARLLIVYPWTQRFFASFGNLATASAITGNAMVHAHGKKVLTSFGEAVKNLDNIKNTFAQLSELHCDKLHVDPENFKLLGDILIIVLAAHFGKDFTPDCQAAWKKLVRVVAHALARKYH

SEQ ID NO: 611 - protein, 147 aa, Gallus gallus
MVHWSAEEKQLITSVWSKVNVEECGAEALARLLIVYPWTQRFFDNFGNLSSPTAIIGNPKVRAHGKKVLSSFGEAVKNLDNIKNTYAKLSELHCEKLHVDPENFRLLGNILIIVLAAHFTKDFTPTCQAVWQKLVSVVAHALAYKYH

SEQ ID NO: 612 - protein, 147 aa, Cyprinus carpio
MHDAELVLKCWGGVEADFEGTGGEVLTRLFKQHPETQKLFPKFVGIASNELAGNAAVKAHGATVLKKLGELLKARGDHAAILKPLATTHANTHKIALNNFRLITEVLVKVMAEKAGLDAGGQSALRRVMDVVIGDIDTYYKEIGFAG

SEQ ID NO: 613 - protein, 147 aa, Thunnus albacares
MADFDAVLKCWGPVEADYTTMGGLVLTRLFKEHPETQKLFPKFAGIAQADIAGNAAISAHGATVLKKLGELLKAKGSHAAILKPLANSHATKHKIPINNFKLISEVLVKVMHEKAGLDAGGQTALRNVMGIIIADLEANYKELGFSG

SEQ ID NO: 614 - protein, 149 aa, Heterodontus portusjacksoni
MTEWEHVNKVWAVVEPDIPAVGLAILLRLFKEHKETKDLFPKFKEIPVQQLGNNEDLRKHGVTVLRALGNILKQKGKHSTNVKELADTHINKHKIPPKNFVLITNIAVKVLTEMYPSDMTGPMQESFSKVFTVICSDLETLYKEANFQG

SEQ ID NO: 615 - protein, 144 aa, Vicia faba
MGFTEKQEALVNSSSQLFKQNPSNYSVLFYTIILQKAPTAKAMFSFLKDSAGVVDSPKLGAHAEKVFGMVRDSAVQLRATGEVVLDGKDGSIHIQKGVLDPHFVVVKEALLKTIKEASGDKWSEELSAAWEVAYDGLATAIKAA

SEQ ID NO: 616 - protein, 148 aa, Pisum sativum
MGFTDKQEALVNSSSEFKQNLPGYSILFYTIVLEKAPAAKGLFSFLKDTAGVEDSPKLQAHAEQVFGLVRDSAAQLRTKGEVVLGNATLGAIHVQKGVTNPHFVVVKEALLQTIKKASGNNWSEELNTAWEVAYDGLATAIKKAMKTA

SEQ ID NO: 617 - protein, 154 aa, Lupinus luteus
MGVLTDVQVALVKSSFEEFNANIPKNTHRFFTLVLEIAPGAKDLFSFLKGSSEVPQNNPDLQAHAGKVFKLTYEAAIQLQVNGAVASDATLKSLGSVHVSKGVVDAHFPVVKEAILKTIKEVVGDKWSEELNTAWTIAYDELAIIIKKEMKDAA

SEQ ID NO: 618 - protein, 154 aa, Lupinus luteus
MGALTESQAALVKSSWEEFNANIPKHTHRFFILVLEIAPAAKDLFSFLKGTSEVPQNNPELQAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 619 - protein, 214 aa, Bos taurus
MKLLILTCLVAVALARPKHPIKHQGLPQEVLNENLLRFFVAPFPEVFGKEKVNELSKDIGSESTEDQAMEDIKQMEAESISSSEEIVPNSVEQKHIQKEDVPSERYLGYLEQLLRLKKYKVPQLEIVPNSAEERLHSMKEGIHAQQKEPMIGVNQELAYFYPELFRQFYQLDAYPSGAWYYVPLGTQYTDAPSFSDIPNPIGSENSEKTTMPLW

SEQ ID NO: 620 - protein, 125 aa, Bos taurus
VPNSVEQKHIQKEDVPSERYLGYLEQLLRLKKYKVPQLEIVPNSAEERLHSMKEGIHAQQKEPMIGVNQELAYFYPELFRQFYQLDAYPSGAWYYVPLGTQYTDAPSFSDIPNPIGSENSEKTTM

SEQ ID NO: 621 - protein, 222 aa, Bos taurus
MKFFIFTCLLAVALAKNTMEHVSSSEESIISQETYKQEKNMAINPSKENLCSTFCKEVVRNANEEEYSIGSSSEESAEVATEEVKITVDDKHYQKALNEINQFYQKFPQYLQYLYQGPIVLNPWDQVKRNAVPITPTLNREQLSTSEENSKKTVDMESTEVFTKKTKLTEEEKNRLNFLKKISQRYQKFALPQYLKTVYQHQKAMKPWIQPKTKVIPYVRYL

SEQ ID NO: 622 - protein, 32 aa, Bos taurus
LPQYLKTVYQHQKAMKPWIQPKTKVIPYVRYL

SEQ ID NO: 623 - protein, 224 aa, Bos taurus
MKVLILACLVALALARELEELNVPGEIVESLSSSEESITRINKKIEKFQSEEQQQTEDELQDKIHPFAQTQSLVYPFPGPIPNSLPQNIPPLTQTPVVVPPFLQPEVMGVSKVKEAMAPKHKEMPFPKYPVEPFTESQSLTLTDVENLHLPLPLLQSWMHQPHQPLPPTVMFPPQSVLSLSQSKVLPVPQKAVPYPQRDMPIQAFLLYQEPVLGPVRGPFPIIV

SEQ ID NO: 624 - protein, 122 aa, Bos taurus
ITRINKKIEKFQSEEQQQTEDELQDKIHPFAQTQSLVYPFPGPIPNSLPQNIPPLTQTPVVVPPFLQPEVMGVSKVKEAMAPKHKEMPFPKYPVEPFTESQSLTLTDVENLHLPLPLLQSWM

SEQ ID NO: 625 - protein, 190 aa, Bos taurus
MMKSFFLVVTILALTLPFLGAQEQNQEQPIRCEKDERFFSDKIAKYIPIQYVLSRYPSYGLNYYQQKPVALINNQFLPYPYYAKPAAVRSPAQILQWQVLSNTVPAKSCQAQPTTMARHPHPHLSFMAIPPKKNQDKTEIPTINTIASGEPTSTPTTEAVESTVATLEDSPEVIESPPEINTVQVTSTAV

SEQ ID NO: 626 - protein, 65 aa, Bos taurus
VALINNQFLPYPYYAKPAAVRSPAQILQWQVLSNTVPAKSCQAQPTTMARHPHPHLSFMAIPPKK

SEQ ID NO: 627 - protein, 178 aa, Bos taurus
MKCLLLALALTCGAQALIVTQTMKGLDIQKVAGTWYSLAMAASDISLLDAQSAPLRVYVEELKPTPEGDLEILLQKWENGECAQKKIIAEKTKIPAVFKIDALNENKVLVLDTDYKKYLLFCMENSAEPEQSLACQCLVRTPEVDDEALEKFDKALKALPMHIRLSFNPTQLEEQCHI

SEQ ID NO: 628 - protein, 121 aa, Bos taurus
VYVEELKPTPEGDLEILLQKWENGECAQKKIIAEKTKIPAVFKIDALNENKVLVLDTDYKKYLLFCMENSAEPEQSLACQCLVRTPEVDDEALEKFDKALKALPMHIRLSFNPTQLEEQCH

SEQ ID NO: 629 - protein, 180 aa, Bubalus bubalis
MKCLLLALGLALACAAQAIIVTQTMKGLDIQKVAGTWYSLAMAASDISLLDAQSAPLRVYVEELKPTPEGDLEILLQKWENGECAQKKIIAEKTKIPAVFKIDALNENKVLVLDTDYKKYLLFCMENSAEPEQSLACQCLVRTPEVDDEALEKFDKALKALPMHIRLSFNPTQLEEQCHV

SEQ ID NO: 630 - protein, 180 aa, Capra hircus
MKCLLLALGLALACGIQAIIVTQTMKGLDIQKVAGTWYSLAMAASDISLLDAQSAPLRVYVEELKPTPEGNLEILLQKWENGECAQKKIIAEKTKIPAVFKIDALNENKVLVLDTDYKKYLLFCMENSAEPEQSLACQCLVRTPEVDKEALEKFDKALKALPMHIRLAFNPTQLEGQCHV

SEQ ID NO: 631 - protein, 607 aa, Bos taurus
MKWVTFISLLLLFSSAYSRGVFRRDTHKSEIAHRFKDLGEEHFKGLVLIAFSQYLQQCPFDEHVKLVNELTEFAKTCVADESHAGCEKSLHTLFGDELCKVASLRETYGDMADCCEKQEPERNECFLSHKDDSPDLPKLKPDPNTLCDEFKADEKKFWGKYLYEIARRHPYFYAPELLYYANKYNGVFQECCQAEDKGACLLPKIETMREKVLASSARQRLRCASIQKFGERALKAWSVARLSQKFPKAEFVEVTKLVTDLTKVHKECCHGDLLECADDRADLAKYICDNQDTISSKLKECCDKPLLEKSHCIAEVEKDAIPENLPPLTADFAEDKDVCKNYQEAKDAFLGSFLYEYSRRHPEYAVSVLLRLAKEYEATLEECCAKDDPHACYSTVFDKLKHLVDEPQNLIKQNCDQFEKLGEYGFQNALIVRYTRKVPQVSTPTLVEVSRSLGKVGTRCCTKPESERMPCTEDYLSLILNRLCVLHEKTPVSEKVTKCCTESLVNRRPCFSALTPDETYVPKAFDEKLFTFHADICTLPDTEKQIKKQTALVELLKHKPKATEEQLKTVMENFVAFVDKCCAADDKEACFAVEGPKLVVSTQTALA

SEQ ID NO: 632 - protein, 90 aa, Bos taurus
IETMREKVLASSARQRLRCASIQKFGERALKAWSVARLSQKFPKAEFVEVTKLVTDLTKVHKECCHGDLLECADDRADLAKYICDNQDTI

SEQ ID NO: 633 - protein, 705 aa, Gallus gallus
MKLILCTVLSLGIAAVCFAAPPKSVIRWCTISSPEEKKCNNLRDLTQQERISLTCVQKATYLDCIKAIANNEADAISLDGGQAFEAGLAPYKLKPIAAEVYEHTEGSTTSYYAVAVVKKGTEFTVNDLQGKTSCHTGLGRSAGWNIPIGTLLHRGAIEWEGIESGSVEQAVAKFFSASCVPGATIEQKLCRQCKGDPKTKCARNAPYSGYSGAFHCLKDGKGDVAFVKHTTVNENAPDQKDEYELLCLDGSRQPVDNYKTCNWARVAAHAVVARDDNKVEDIWSFLSKAQSDFGVDTKSDFHLFGPPGKKDPVLKDLLFKDSAIMLKRVPSLMDSQLYLGFEYYSAIQSMRKDQLTPSPRENRIQWCAVGKDEKSKCDRWSVVSNGDVECTVVDETKDCIIKIMKGEADAVALDGGLVYTAGVCGLVPVMAERYDDESQCSKTDERPASYFAVAVARKDSNVNWNNLKGKKSCHTAVGRTAGWVIPMGLIHNRTGTCNFDEYFSEGCAPGSPPNSRLCQLCQGSGGIPPEKCVASSHEKYFGYTGALRCLVEKGDVAFIQHSTVEENTGGKNKADWAKNLQMDDFELLCTDGRRANVMDYRECNLAEVPTHAVVVRPEKANKIRDLLERQEKRFGVNGSEKSKFMMFESQNKDLLFKDLTKCLFKVREGTTYKEFLGDKFYTVISSLKTCNPSDILQMCSFLEGK

SEQ ID NO: 634 - protein, 169 aa, Gallus gallus
LILCTVLSLGIAAVCFAAPPKSVIRWCTISSPEEKKCNNLRDLTQQERISLTCVQKATYLDCIKAIANNEADAISLDGGQAFEAGLAPYKLKPIAAEVYEHTEGSTTSYYAVAVVKKGTEFTVNDLQGKTSCHTGLGRSAGWNIPIGTLLHRGAIEWEGIESGSVEQAV

SEQ ID NO: 635 - protein, 562 aa, Glycine max
MGKPFTLSLSSLCLLLLSSACFAISSSKLNECQLNNLNALEPDHRVESEGGLIQTWNSQHPELKCAGVTVSKLTLNRNGLHSPSYSPYPRMIIIAQGKGALGVAIPGCPETFEEPQEQSNRRGSRSQKQQLQDSHQKIRHFNEGDVLVIPPSVPYWTYNTGDEPVVAISLLDTSNFNNQLDQTPRVFYLAGNPDIEYPETMQQQQQQKSHGGRKQGQHQQEEEEEGGSVLSGFSKHFLAQSFNTNEDIAEKLESPDDERKQIVTVEGGLSVISPKWQEQQDEDEDEDEDDEDEQIPSHPPRRPSHGKREQDEDEDEDEDKPRPSRPSQGKRNKTGQDEDEDEDEDQPRKSREWRSKKTQPRRPRQEEPRERGCETRNGVEENICTLKLHENIARPSRADFYNPKAGRISTLNSLTLPALRQFQLSAQYVVLYKNGIYSPHWNLNANSVIYVTRGQGKVRVVNCQGNAVFDGELRRGQLLVVPQNFVVAEQAGEQGFEYIVFKTHHNAVTSYLKDVFRAIPSEVLAHSYNLRQSQVSELKYEGNWGPLVNPESQQGSPRVKVA

SEQ ID NO: 636 - protein, 48 aa, Glycine max
WNSQHPELKCAGVTVSKLTLNRNGLHSPSYSPYPRMIIIAQGKGALGV

SEQ ID NO: 637 - protein, 329 aa, Escherichia coli
MHKFTKALAAIGLAAVMSQSAMAENLKLGFLVKQPEEPWFQTEWKFADKAGKDLGFEVIKIAVPDGEKTLNAIDSLAASGAKGFVICTPDPKLGSAIVAKARGYDMKVIAVDDQFVNAKGKPMDTVPLVMMAATKIGERQGQELYKEMQKRGWDVKESAVMAITANELDTARRRTTGSMDALKAAGFPEKQIYQVPTKSNDIPGAFDAANSMLVQHPEVKHWLIVGMNDSTVLGGVRATEGQGFKAADIIGIGINGVDAVSELSKAQATGFYGSLLPSPDVHGYKSSEMLYNWVAKDVEPPKFTEVTDVVLITRDNFKEELEKKGLGGK

SEQ ID NO: 638 - protein, 1460 aa, Saccharomyces cerevisiae
MKEVVVSETPKRIKGLEFSALSAADIVAQSEVEVSTRDLFDLEKDRAPKANGALDPKMGVSSSSLECATCHGNLASCHGHFGHLKLALPVFHIGYFKATIQILQGICKNCSAILLSETDKRQFLHELRRPGVDNLRRMGILKKILDQCKKQRRCLHCGALNGVVKKAAAGAGSAALKIIHDTFRWVGKKSAPEKDIWVGEWKEVLAHNPELERYVKRCMDDLNPLKTLNLFKQIKSADCELLGIDATVPSGRPETYIWRYLPAPPVCIRPSVMMQDSPASNEDDLTVKLTEIVWTSSLIKAGLDKGISINNMMEHWDYLQLTVAMYINSDSVNPAMLPGSSNGGGKVKPIRGFCQRLKGKQGRFRGNLSGKRVDFSGRTVISPDPNLSIDEVAVPDRVAKVLTYPEKVTRYNRHKLQELIVNGPNVHPGANYLLKRNEDARRNLRYGDRMKLAKNLQIGDVVERHLEDGDVVLFNRQPSLHRLSILSHYAKIRPWRTFRLNECVCTPYNADFDGDEMNLHVPQTEEARAEAINLMGVKNNLLTPKSGEPIIAATQDFITGSYLISHKDSFYDRATLTQLLSMMSDGIEHFDIPPPAIMKPYYLWTGKQVFSLLIKPNHNSPVVINLDAKNKVFVPPKSKSLPNEMSQNDGFVIIRGSQILSGVMDKSVLGDGKKHSVFYTILRDYGPQEAANAMNRMAKLCARFLGNRGFSIGINDVTPADDLKQKKEELVEIAYHKCDELITLFNKGELETQPGCNEEQTLEAKIGGLLSKVREEVGDVCINELDNWNAPLIMATCGSKGSTLNVSQMVAVVGQQIISGNRVPDGFQDRSLPHFPKNSKTPQSKGFVRNSFFSGLSPPEFLFHAISGREGLVDTAVKTAETGYMSRRLMKSLEDLSCQYDNTVRTSANGIVQFTYGGDGLDPLEMEGNAQPVNFNRSWDHAYNITFNNQDKGLLPYAIMETANEILGPLEERLVRYDNSGCLVKREDLNKAEYVDQYDAERDFYHSLREYINGKATALANLRKSRGMLGLLEPPAKELQGIDPDETVPDNVKTSVSQLYRISEKSVRKFLEIALFKYRKARLEPGTAIGAIGAQSIGEPGTQMTLKTFHFAGVASMNVTLGVPRIKEIINASKVISTPIINAVLVNDNDERAARVVKGRVEKTLLSDVAFYVQDVYKDNLSFIQVRIDLGTIDKLQLELTIEDIAVAITRASKLKIQASDVNIIGKDRIAINVFPEGYKAKSISTSAKEPSENDVFYRMQQLRRALPDVVVKGLPDISRAVINIRDDGKRELLVEGYGLRDVMCTDGVIGSRTTTNHVLEVFSVLGIEAARYSIIREINYTMSNHGMSVDPRHIQLLGDVMTYKGEVLGITRFGLSKMRDSVLQLASFEKTTDHLFDAAFYMKKDAVEGVSECIILGQTMSIGTGSFKVVKGTNISEKDLVPKRCLFESLSNEAALKAN

SEQ ID NO: 639 - protein, 214 aa, Saccharomyces cerevisiae
MARIVVLISGSGSNLQALIDAQKQGQLGEDAHIVSVISSSKKAYGLTRAADNNIPTKVCSLYPYTKGIAKEDKAARAKARSQFENDLAKLVLEEKPDVIICAGWLLILGSTFLSQLQSVPILNLHPALPGCFDGTTHAIEMAWRKCQDENKPLTAGCMVHYVIEEVDKGEPLVVKKLEIIPGEETLEQYEQRVHDAEHIAIVEATYKVLQQLHK

SEQ ID NO: 640 - protein, 364 aa, Saccharomyces cerevisiae
MSAPKKIVVLPGDHVGQEITAEAIKVLKAISDVRSNVKFDFENHLIGGAAIDATGVPLPDEALEASKKADAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 641 - protein, 65 aa, Mus musculus
MEHSGILASLILIAVLPQGSPFKIQVTEYEDKVFVTCNTSVMHLDGTVEGWFAKNKTLNLGKGVL

SEQ ID NO: 642 - protein, 82 aa, Mus musculus
MEHSGILASLILIAVLPQGSPFKIQVTEYEDKVFVTCNTSVMHLDGTVEGWFAKNKTLNLGKGVLDPRGIYLCNGTEQLAKV

SEQ ID NO: 643 - protein, 146 aa, Vitreoscilla stercoraria
MLDQQTINIIKATVPVLKEHGVTITTTFYKNLFAKHPEVRPLFDMGRQESLEQPKALAMTVLAAAQNIENLPAILPAVKKIAVKHCQAGVAAAHYPIVGQELLGAIKEVLGDAATDDILDAWGKAYGVIADVFIQVEADLYAQAVE

SEQ ID NO: 644 - protein, 61 aa, Mesocricetus auratus
QVEQDGRSGHGLRRSSKFCLKEHKALKTLGIIMGTFTLCWLPFFIVNIVHVIQDNLIPKEV

SEQ ID NO: 645 - protein, 31 aa, Mesocricetus auratus
KEHKALKTLGIIMGTFTLCWLPFFIVNIVHV

SEQ ID NO: 646 - protein, 516 aa, Glycine max
MGKPFFTLSLSSLCLLLLSSACFAITSSKFNECQLNNLNALEPDHRVESEGGLIETWNSQHPELQCAGVTVSKRTLNRNGSHLPSYLPYPQMIIVVQGKGAIGFAFPGCPETFEKPQQQSSRRGSRSQQQLQDSHQKIRHFNEGDVLVIPLGVPYWTYNTGDEPVVAISPLDTSNFNNQLDQNPRVFYLAGNPDIEHPETMQQQQQQKSHGGRKQGQHRQQEEEGGSVLSGFSKHFLAQSFNTNEDTAEKLRSPDDERKQIVTVEGGLSVISPKWQEQEDEDEDEDEEYGRTPSYPPRRPSHGKHEDDEDEDEEEDQPRPDHPPQRPSRPEQQEPRGRGCQTRNGVEENICTMKLHENIARPSRADFYNPKAGRISTLNSLTLPALRQFGLSAQYVVLYRNGIYSPDWNLNANSVTMTRGKGRVRVVNCQGNAVFDGELRRGQLLVVPQNPAVAEQGGEQGLEYVVFKTHHNAVSSYIKDVFRVIPSEVLSNSYNLGQSQVRQLKYQGNSGPLVNP

SEQ ID NO: 647 - protein, 63 aa, Glycine max
LIETWNSQHPELQCAGVTVSKRTLNRNGSHLPSYLPYPQMIIVVQGKGAIGFAFPGCPETFEK

SEQ ID NO: 648 - protein, 485 aa, Glycine max
MAKLVLSLCFLLFSGCFALREQAQQNECQIQKLNALKPDNRIESEGGFIETWNPNNKPFQCAGVALSRCTLNRNALRRPSYTNGPQEIYIQQGNGIFGMIFPGCPSTYQEPQESQQRGRSQRPQDRHQKVHRFREGDLIAVPTGVAWWMYNNEDTPVVAVSIIDTNSLENQLDQMPRRFYLAGNQEQEFLKYQQQQQGGSQSQKGKQQEEENEGSNILSGFAPEFLKEAFGVNMQIVRNLQGENEEEDSGAIVTVKGGLRVTAPAMRKPQQEEDDDDEEEQPQCVETDKGCQRQSKRSRNGIDETICTMRLRQNIGQNSSPDIYNPQAGSITTATSLDFPALWLLKLSAQYGSLRKNAMFVPHYTLNANSIIYALNGRALVQVVNCNGERVFDGELQEGGVLIVPQNFAVAAKSQSDNFEYVSFKTNDRPSIGNLAGANSLLNALPEEVIQHTFNLKSQQARQVKNNNPFSFLVPPQESQRRAVA

SEQ ID NO: 649 - protein, 133 aa, Glycine max
HQKVHRFREGDLIAVPTGVAWWMYNNEDTPVVAVSIIDTNSLENQLDQMPRRFYLAGNQEQEFLKYQQQQQGGSQSQKGKQQEEENEGSNILSGFAPEFLKEAFGVNMQIVRNLQGENEEEDSGAIVTVKGGL

SEQ ID NO: 650 - protein, 147 aa, Mus musculus
MVHFTAEEKAAITSIWDKVDLEKVGGETLGRLLIVYPWTQRFFDKFGNLSSAQAIMGNPRIKAHGKKVLTSLGLAVKNMDNLKETFAHLSELHCDKLHADPENFKLLGNMLVIVLSSYFGKEFTAEAQAAWQKLVVGVATALSHKYH

SEQ ID NO: 651 - protein, 147 aa, Mus musculus
MVHFTAEEKAAITSIWDKVDLEKVGGETLGRLLIVYPWTQRFFDKFGNLSSALAIMGNPRIRAHGKKVLTSLGLGVKNMDNLKETFAHLSELHCDKLHVDPENFKLLGNMLVIVLSTHFAKEFTPEVQAAWQKLVIGVANALSHKYH

SEQ ID NO: 652 - protein, 329 aa, Trypanosoma brucei
MKVEIVELVVLLFSVTCVDAWLQGADCTRVADHKEHAPVTEAVCYLRCLSDALNKLYSEGEKKLLVTEEVYANASLILDDMEGRAGESSTYLSVIRGVMEEQTDRLEKLISYGNKMGNLVAKAGGLFAALEDSLKEVRKEIPGALIKTNKYYTSVAEIVRTVWEDVGEILWKETEAKCGSQKVEGVGEIQTECGAHTCPFADNGVAASAVDKYKGHCLYVGRNSYLRHCFNLPRGRLYRHGPVNTLGDALEWEENWSDYMNFELTVKVQKIFGPLIASFDVGIAPSTLAEMINNITSLQSRFNEVHSNFTSILFTTKLKTEVYNTDSTI

SEQ ID NO: 653 - protein, 338 aa, Rattus norvegicus
MLSALARPVGAALRRSFSTSAQNNAKVAVLGASGGIGQPLSLLLKNSPLVSRLTLYDIAHTPGVAADLSHIETRANVKGYLGPEQLPDCLKGCDVVVIPAGVPRKPGMTRDDLFNTNATIVATLTAACAQHCPEAMICIISNPVNSTIPITAEVFKKHGVYNPNKIFGVTTLDIVRANTFVAELKGLDPARVNVPVIGGHAGKTIIPLISQCTPKVDFPQDQLATLTGRIQEAGTEVVKAKAGAGSATLSMAYAGARFVFSLVDAMNGKEGVIECSFVQSKETECTYFSTPLLLGKKGLEKNLGIGKITPFEEKMIAEAIPELKASIKKGEDFVKNMK

SEQ ID NO: 654 - protein, 332 aa, Rattus norvegicus
MAALKDQLIVNLLKEEQVPQNKITVVGVGAVGMACAISILMKDLADELALVDVIEDKLKGEMMDLQHGSLFLKTPKIVSSKDYSVTANSKLVIITAGARQQEGESRLNLVQRNVNIFKFIIPNVVKYSPQCKLLIVSNPVDILTYVAWKISGFPKNRVIGSGCNLDSARFRYLMGERLGVHPLSCHGWVLGEHGDSSVPVWSGVNVAGVSLKSLNPQLGTDADKEQWKDVHKQVVDSAYEVIKLKGYTSWAIGLSVADLAESIMKNLRRVHPISTMIKGLYGIKEDVFLSVPCILGQNGISDVVKVTLTPDEEARLKKSADTLWGIQKELQF

SEQ ID NO: 655 - protein, 495 aa, Glycine max
MAKLVFSLCFLLFSGCCFAFSSREQPQQNECQIQKLNALKPDNRIESEGGLIETWNPNNKPFQCAGVALSRCTLNRNALRRPSYTNGPQEIYIQQGKGIFGMIYPGCPSTFEEPQQPQQRGQSSRPQDRHQKIYNFREGDLIAVPTGVAWWMYNNEDTPVVAVSIIDTNSLENQLDQMPRRFYLAGNQEQEFLKYQQEQGGHQSQKGKHQQEEENEGGSILSGFTLEFLEHAFSVDKQIAKNLQGENEGEDKGAIVTVKGGLSVIKPPTDEQQQRPQEEEEEEEDEKPQCKGKDKHCQRPRGSQSKSRRNGIDETICTMRLRHNIGQTSSPDIYNPQAGSVTTATSLDFPALSWLRLSAEFGSLRKNAMFVPHYNLNANSIIYALNGRALIQVVNCNGERVFDGELQEGRVLIVPQNFVVAARSQSDNFEYVSFKTNDTPMIGTLAGANSLLNALPEEVIQHTFNLKSQQARQIKNNNPFKFLVPPQESQKRAVA

SEQ ID NO: 656 - protein, 200 aa, Glycine max
LSGFTLEFLEHAFSVDKQIAKNLQGENEGEDKGAIVTVKGGLSVIKPPTDEQQQRPQEEEEEEEDEKPQCKGKDKHCQRPRGSQSKSRRNGIDETICTMRLRHNIGQTSSPDIYNPQAGSVTTATSLDFPALSWLRLSAEFGSLRKNAMFVPHYNLNANSIIYALNGRALIQVVNCNGERVFDGELQEGRVLIVPQNFVV

SEQ ID NO: 657 - protein, 94 aa, Saccharomyces cerevisiae
ADVPKELMDEIHQLEDMFTVDSETLRKVVKHFIDELNKGLTKKGGNIPMIPGWVMEFPTGKESGNYLAIDLGGTNLRVVLVKLSGNHTFDTTQS

SEQ ID NO: 658 - protein, 79 aa, Saccharomyces cerevisiae
IHQLEDMFTVDSETLRKVVKHFIDELNKGLTKKGGNIPMIPGWVMEFPTGKESGNYLAIDLGGTNLRVVLVKLSGNHTF

SEQ ID NO: 659 - protein, 272 aa, Escherichia coli
MKLTTHHLRTGAALLLAGILLAGCDQSSSDAKHIKVGVINGAEQDVAEVAKKVAKEKYGLDVELVGFSGSLLPNDATNHGELDANVFQHRPFLEQDNQAHGYKLVAVGNTFVFPMAGYSKKIKTVAQIKEGATVAIPNDPTNLGRALLLLQKEKLITLKEGKGLLPTALDITDNPRHLQIMELEGAQLPRVLDDPKVDVAIISTTYIQQTGLSPVHDSVFIEDKNSPYVNILVAREDNKNAENVKEFLQSYQSPEVAKAAETIFNGGAVPGW

SEQ ID NO: 660 - protein, 84 aa, Mus musculus
VDSFIKGTYTQKLSVPDGLKVSNSSARGWVIHPLGLYRLFPTWMMFASVLPALLVFILIFLESQITTLIVSKPERKMIKGSGFH

SEQ ID NO: 661 - protein, 59 aa, Mus musculus
MGVTSLSGIQLFDRILLLFKPPKYHPDVPFVKRVKTWRMHLFTGIQIICLAVLWVVKST

SEQ ID NO: 662 - protein, 918 aa, Saccharomyces cerevisiae [sequence omitted]

SEQ ID NO: 663 - protein, 149 aa, Mus musculus
LVGIKVDKGVVPLAGTDGETTTQGLDGLLERCAQYKKDGADFAKWRCVLKISDRTPSALAILENANVLARYASICQQNGIVPIVEPEILPDGDHDLKRCQYVTEKVLAAVYKALSDHHVYLEGTLLKPNMVTPGHACPIKYSPEEIAMA

SEQ ID NO: 664 - protein, 504 aa, Rattus norvegicus
MDLLSALTLETWVLLAVILVLLYRLGTHRHGIFKKQGIPGPKPLPFLGTVLNYYKGLGRFDMECYKKYGKIWGLFDGQTPVFAIMDTEMIKNVLVKECFSVFTNRRDFGPVGIMGKAVSVAKDEEWKRYRALLSPTFTSGRLKEMFPIIEQYGDILVKYLKQEAETGKPVTMKKVFGAYSMDVITSTSFGVNVDSLNNPKDPFVEKTKKLLRFDFFDPLFLSVVLFPFLTPIYEMLNICMFPKDSIAFFQKFVHRIKETRLDSKHKHRVDFLQLMLNAHNNSKDEVSHKALSDVEIIAQSVIFIFAGYETTSSTLSFVLYFLATHPDIQKKLQEEIDGALPSKAPPTYDIVMEMEYLDMVLNETLRLYPIGNRLERVCKKDIELDGLFIPKGSVVTIPTYALHHDPQHWPKPEEFHPERFSKENKGSIDPYVYLPFGNGPRNCIGMRFALMNMKLALTKVLQNFSFQPCKETQIPLKLSRQAILEPEKPIVLKVLPRDAVINGA

SEQ ID NO: 665 - protein, 83 aa, Bos taurus
STITTDEGATKCVVAWPEDSGGKMLLLYHLIVIALIYFLPLVVMFVAYSVIGLTLWRRSVPGHQAHGANLRHLQAKKKFVKTM

SEQ ID NO: 666 - protein, 27 aa, Bos taurus
KKFVKTMVLVVVTFAICWLPYHLYFIL

SEQ ID NO: 667 - protein, 745 aa, Enterococcus hirae
MNNGIDPENETNKKGAIGKNPEEKITVEQTNTKNNLQEHGKMENMDQHHTHGHMERHQQMDHGHMSGMDHSHMDHEDMSGMNHSHMGHENMSGMDHSMHMGNFKQKFWLSLILAIPIILFSPMMGMSFPFQVTFPGSNWVVLVLATILFIYGGQPFLSGAKMELKQKSPAMMTLIAMGITVAYVYSVYSFIANLINPHTHVMDFFWELATLIVIMLLGHWIEMNAVSNASDALQKLAELLPESVKRLKKDGTEETVSLKEVHEGDRLIVRAGDKMPTDGTIDKGHTIVDESAVTGESKGVKKQVGDSVIGGSINGDGTIEITVTGTGENGYLAKVMEMVRKAQGEKSKLEFLSDKVAKWLFYVALVVGIIAFIAWLFLANLPDALERMVTVFIIACPHALGLAIPLVVARSTSIAAKNGLLLKNRNAMEQANDLDVIMLDKTGTLTQGKFTVTGIEILDEAYQEEEILKYIGALEAHANHPLAIGIMNYLKEKKITPYQAQEQKNLAGVGLEATVEDKDVKIINEKEAKRLGLKIDPERLKNYEAQGNTVSFLVVSDKLVAVIALGDVIKPEAKEFIQAIKEKNIIPVMLTGDNPKAAQAVAEYLGINEYYGGLLPDDKEAIVQRYLDQGKKVIMVGDGINDAPSLARATIGMAIGAGTDIAIDSADVVLTNSDPKDILHFLELAKETRRKMIQNLWWGAGYNIIAIPLAAGILAPIGLILSPAVGAVLMSLSTVVVALNALTLK

SEQ ID NO: 668 - protein, 413 aa, Rattus norvegicus
MAFIAALGLLMAGICPAVLCDGTLGRDTLSHEDHGKGRQLHSLTLASSNTDFALSLYKKLALRNPDKNVVFSPLSISAALTILSLGAKDSTMEEILEGLKFNLTEITEEEIHQGFGHLLQRLSQPEDQVEINTGSALFIDKEQPILSEFQEKTRALYQAEAFIADFKQPNEAKKLINDYVSNQTQGKIAELFSDLEERTSMVLVNYLLFKGKWKVPFNPNDTFESEFYLDEKRSVKVPMMKIKEVTTPYVRDEELSCSVLELKYTGNASALFILPDQGKMQQVESSLQPETLKKWKDSLIPRIINDLRMPKFSISTDYSLKEVLPELGIKKVFSQQADLSRITGTKDLYVSQVVHKAVLDVDETGTEATAATGVATVIRRQPRTLNFNRPFMVVITDMDSQSILFVAKITNPK

SEQ ID NO: 669 - protein, 332 aa, Mus musculus
MATLKDQLIVNLLKEEQAPQNKITVVGVGAVGMACAISILMKDLADELALVDVMEDKLKGEMMDLQHGSLFLKTPKIVSSKDYCVTANSKLVIITAGARQQEGESRLNLVQRNVNIFKFIIPNIVKYSPHCKLLIVSNPVDILTYVAWKISGFPKNRVIGSGCNLDSARFRYLMGERLGVHALSCHGWVLGEHGDSSVPVWSGVNVAGVSLKSLNPELGTDADKEQWKEVHKQVVDSAYEVIKLKGYTSWAIGLSVADLAESIMKNLRRVHPISTMIKGLYGINEDVFLSVPCILGQNGISDVVKVTLTPEEEARLKKSADTLWGIQKELQF

SEQ ID NO: 670 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 671 - protein, 242 aa, Limulus polyphemus
MKTFHGPTCGTAVSLCLLLFLTSALEEGEITSKVKFPPSSSPSFPRLVMVGTLPDLQEITLCYWFKVNCLKGTLHMFSYATAKKDNELLTLLDEQGDFLFNVHGAPQLKVQCPNKIHIGKWHHVCHTWSSWEGEATIAVDGFHCKGNATGIAVGRTLSQGGLVVLGQDQDSVGGKFDATQSLEGELSELNLWNTVLNHEQIKYLSKCAHPSERHIYGNIIQWDKTQFKAYDGVVLSPNEICA

SEQ ID NO: 672 - protein, 399 aa, Hordeum vulgare
MATTLATDVRLSIAHQTRFALRLRSAISSNPERAAGNVAFSPLSLHVALSLITAGAAATRDQLVAILGDGGAGDAKELNALAEQVVQFVLANESSTGGPRIAFANGIFVDASLSLKPSFEELAVCQYKAKTQSVDFQHKTLEAVGQVNSWVEQVTTGLIKQILPPGSVDNTTKLILGNALYFKGAWDQKFDESNTKCDSFHLLDGSSIQTQFMSSTKKQYISSSDNLKVLKLPYAKGHDKRQFSMYILLPGAQDGLWSLAKRLSTEPEFIENHIPKQTVEVGRFQLPKFKISYQFEASSLLRALGLQLPFSEEADLSEMVDSSQGLEISHVFHKSFVEVNEEGTEAGAATVAMGVAMSMPLKVDLVDFVANHPFLFLIREDIAGVVVFVGHVTNPLISA

SEQ ID NO: 673 - protein, 376 aa, Rattus norvegicus
MSTAGKVIKCKAAVLWEPHKPFTIEDIEVAPPKAHEVRIKMVATGVCRSDDHAVSGSLFTPLPAVLGHEGAGIVESIGEGVTCVKPGDKVIPLFSPQCGKCRICKHPESNLCCQTKNLTQPKGALLDGTSRFSCRGKPIHHFISTSTFSQYTVVDDIAVAKIDAAAPLDKVCLIGCGFSTGYGSAVQVAKVTPGSTCAVFGLGGVGLSVVIGCKTAGAAKIIAVDINKDKFAKAKELGATDCINPQDYTKPIQEVLQEMTDGGVDFSFEVIGRLDTMTSALLSCHSACGVSVIVGVPPSAQSLSVNPMSLLLGRTWKGAIFGGFKSKDAVPKLVADFMAKKFPLEPLITHVLPFEKINEAFDLLRAGKSIRTVLTF

SEQ ID NO: 674 - protein, 347 aa, Rattus norvegicus
MRALGAVVTLLLWGQLFAVELGNDATDIEDDSCPKPPEIANGYVEHLVRYRCRQFYKLQTEGDGIYTLNSEKQWVNPAAGDKLPKCEAVCGKPKHPVDQVQRIIGGSMDAKGSFPWQAKMISRHGLTTGATLISDQWLLTTAQNLFLNHSENATAKDIAPTLTLYVGKNQLVEIEKVVLHPERSVVDIGLIKLKQKVLVTEKVMPICLPSKDYVAPGRMGYVSGWGRNVNFRFTERLKYVMLPVADQEKCELHYEKSTVPEKKGAVSPVGVQPILNKHTFCAGLTKYEEDTCYGDAGSAFAVHDTEEDTWYAAGILSFDKSCAVAEYGVYVRATDLKDWVQETMAKN

SEQ ID NO: 675 - protein, 151 aa, Rattus norvegicus
IIGGSMDAKGSFPWQAKMISRHGLTTGATLISDQWLLTTAQNLFLNHSENATAKDIAPTLTLYVGKNQLVEIEKVVLHPERSVVDIGLIKLKQKVLVTEKVMPICLPSKDYVAPGRMGYVSGWGRNVNFRFTERLKYVMLPVADQEKCELH

SEQ ID NO: 676 - protein, 182 aa, Rattus norvegicus
IIGGSMDAKGSFPWQAKMISRHGLTTGATLISDQWLLTTAQNLFLNHSENATAKDIAPTLTLYVGKNQLVEIEKVVLHPERSVVDIGLIKLKQKVLVTEKVMPICLPSKDYVAPGRMGYVSGWGRNVNFRFTERLKYVMLPVADQEKCELHYEKSTVPEKKGAVSPVGVQPILNKHTFCAGL

SEQ ID NO: 677 - protein, 188 aa, Rattus norvegicus
MENIMPFALLGLCVGLAAGTEGAVVKDFDISKFLGFWYEIAFASKMGTPGLAHKEEKMGAMVVELKENLLALTTTYYSEDHCVLEKVTATEGDGPAKFQVTRLSGKKEVVVEATDYLTYAIIDITSLVAGAVHRTMKLYSRSLDDNGEALYNFRKITSDHGFSETDLYILKHDLTCVKVLQSAAESRP

SEQ ID NO: 678 - protein, 334 aa, Escherichia coli
MSDLYKKHFLKLLDFTPAQFTSLLTLAAQLKADKKNGKEVQKLTGKNIALIFEKDSTRTRCSFEVAAFDQGARVTYLGPSGSQIGHKESIKDTARVLGRMYDGIQYRGHGQEVVETLAQYAGVPVWNGLTNEFHPTQLLADLMTMQEHLPGKAFNEMTLVYAGDARNNMGNSMLEAAALTGLDLRLLAPKACWPEESLVAECSALAEKHGGKITLTEDVAAGVKGADFIYTDVWVSMGEAKEKWAERIALLRGYQVNAQMMALTDNPNVKFLHCLPAFHDDQTTLGKQMAKEFDLHGGMEVTDEVFESAASIVFDQAENRMHTIKAVMMATLGE

SEQ ID NO: 679 - protein, 920 aa, Neurospora crassa
MADHSASGAPALSTNIESGKFDEKAAEAAAYQPKPKVEDDEDEDIDALIEDLESHDGHDAEEEEEEATPGGGRVVPEDMLQTDTRVGLTSEEVVQRRRKYGLNQMKEEKENHFLKFLGFFVGPIQFVMEGAAVLAAGLEDWVDFGVICGLLLLNAVVGFVQEFQAGSIVDELKKTLALKAVVLRDGTLKEIEAPEVVPGDILQVEEGTIIPADGRIVTDDAFLQVDQSALTGESLAVDKHKGDQVFASSAVKRGEAFVVITATGDNTFVGRAAALVNAASGGSGHFTEVLNGIGTILLILVIFTLLIVWVSSFYRSNPIVQILEFTLAITIIGVPVGLPAVVTTTMAVGAAYLAKKKAIVQKLSAIESLAGVEILCSDKTGTLTKNKLSLHDPYTVAGVDPEDLMLTACLAASRKKKGIDAIDKAFLKSLKYYPRAKSVLSKYKVLQFHPFDPVSKKVVAVVESPQGERITCVKGAPLFVLKTVEEDHPIPEEVDQAYKNKVAEFATRGFRSLGVARKRGEGSWEILGIMPCMDPPRHDTYKTVCEAKTLGLSIKMLTGDAVGIARETSRQLGLGTNIYNAERLGLGGGGDMPGSEVYDFVEAADGFAEVFPQHKYNVVEILQQRGYLVAMTGDGVNDAPSLKKADTGIAVEGSSDAARSAADIVFLAPGLGAIIDALKTSRQIFHRMYAYVVYRIALSIHLEIFLGLWIAILNRSLNIELVVFIAIFADVATLAIAYDNAPYSQTPVKWNLPKLWGMSVLLGVVLAVGTWITVTTMYAQGENGGIVQNFGNMDEVLFLQISLTENWLIFITRANGPFWSSIPSWQLSGAIFLVDILATCFTIWGWFEHSDTSIVAVVRIWIFSFGIFCIMGGVYYILQDSVGFDNLMHGKSPKGNQKQRSLEDFVVSLQRVSTQHEKSQ

SEQ ID NO: 680 - protein, 397 aa, Rattus norvegicus
MNWHFPFFILTTVTLSSVYSQLNSLSLEELGSDTGIQVFNQIIKSQPHENVVISPHGIASILGMLQLGADGRTKKQLSTVMRYNVNGVGKVLKKINKAIVSKKNKDIVTVANAVFVRNGFKVEVPFAARNKEVFQCEVQSVNFQDPASACDAINFWVKNETRGMIDNLLSPNLIDSALTKLVLVNAVYFKGLWKSRFQPENTKKRTFVAGDGKSYQVPMLAQLSVFRSGSTKTPNGLWYNFIELPYHGESISMLIALPTESSTPLSAIIPHISTKTINSWMNTMVPKRMQLVLPKFTALAQTDLKEPLKALGITEMFEPSKANFAKITRSESLHVSHILQKAKIEVSEDGTKAAVVTTAILIARSSPPWFIVDRPFLFCIRHNPTGAILFLGQVNKP

SEQ ID NO: 681 - protein, 105 aa, Petromyzon marinus
MKLHVAALATLAVVCILAAGSEAAPKAMSDPAVVKAQLFPDAFWESFKNVSMEFKKMVHGLQTSNIGEHAKSLYTDTVAVLTPYLQKIRENVTKMYQVYVESKQH

SEQ ID NO: 682 - protein, 385 aa, Saccharomyces cerevisiae
MVFDLKRIVRPKIYNLEPYRCARDDFTEGILLDANENAHGPTPVELSKTNLHRYPDPHQLEFKTAMTKYRNKTSSYANDPEVKPLTADNLCLGVGSDESIDAIIRACCVPGKEKILVLPPTYSMYSVCANINDIEVVQCPLTVSDGSFQMDTEAVLTILKNDSLIKLMFVTSPGNPTGAKIKTSLIEKVLQNWDNGLVVVDEAYVDFCGGSTAPLVTKYPNLVTLQTLSKSFGLAGIRLGMTYATAELARILNAMKAPYNISSLASEYALKAVQDSNLKKMEATSKIINEEKMRLLKELTALDYVDDQYVGGLDANFLLIRINGGDNVLAKKLYYQLATQSGVVVRFRGNELGCSGCLRITVGTHEENTHLIKYFKETLYKLANE

SEQ ID NO: 683 - protein, 375 aa, Saccharomyces cerevisiae [sequence omitted]

SEQ ID NO: 684 - protein, 380 aa, Saccharomyces cerevisiae
MSEATLLSYTKKLLASPPQLSSTDLHDALLVILSLLQKCDTNSDESLSIYTKVSSFLTALRVTKLDHKAEYIAEAAKAVLRHSDLVDLPLPKKDELHPEDGPVILDIVGTGGDGQNTFNVSTSAAIVASGIQGLKICKHGGKASTSNSGAGDLIGTLGCDMFKVNSSTVPKLWPDNTFMFLLAPFFHHGMGHVSKIRKFLGIPTVFNVLGPLLHPVSHVNKRILGVYSKELAPEYAKAAALVYPGSETFIVWGHVGLDEVSPIGKTTVWHIDPTSSELKLKTFQLEPSMFGLEEHELSKCASYGPKENARILKEEVLSGKYHLGDNNPIYDYILMNTAVLYCLSQGHQNWKEGIIKAEESIHSGNALRSLEHFIDSVSSL

SEQ ID NO: 685 - protein, 100 aa, Saccharomyces cerevisiae
VASGIQGLKICKHGGKASTSNSGAGDLIGTLGCDMFKVNSSTVPKLWPDNTFMFLLAPFFHHGMGHVSKIRKFLGIPTVFNVLGPLLHPVSHVNKRILGV

SEQ ID NO: 686 - protein, 141 aa, Saccharomyces cerevisiae
AEYIAEAAKAVLRHSDLVDLPLPKKDELHPEDGPVILDIVGTGGDGQNTFNVSTSAAIVASGIQGLKICKHGGKASTSNSGAGDLIGTLGCDMFKVNSSTVPKLWPDNTFMFLLAPFFHHGMGHVSKIRKFLGIPTVFNVL

SEQ ID NO: 687 - protein, 440 aa, Trypanosoma brucei
MTLNEKKSINECDLKGKKVLIRVDFNVPVKNGKITNDYRIRSALPTLKKVLTEGGSCVLMSHLGRPKGIPMAQAGKIRSTGGVPGFQQKATLKPVAKALSELLLRPVTFAPDCLNAADVVSKMSPGDVVLLENVRFYKEEGSKKAKDREAMAKILASYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKSAVVSYASAGTGTLSNRWSSL

SEQ ID NO: 688 - protein, 141 aa, Vultur gryphus
VLSGSDKTNVKGVFAKIGGHAEDYGAETLERMFITYPQTKTYFPHFDLQHGSAQIKGHGKKVVGALIEAANHIDDIAASLSKLSDLHAQKLRVDPVNFKLLGQCFLVVVAIHHPSVLTPEVHASLDKFLCAVGNVLTAKYR

SEQ ID NO: 689 - protein, 142 aa, Aegypius monachus
MVLSANDKTNVKTVFTKITGHAEDYGAETLERMFITYPPTKTYFPHFDLHHGSAQIKAHGKKVVGALIEAVNHIDDIAGALSKLSDLHAQKLRVDPVNFKLLGQCFLVVVAIHHPSVLTPEVHASLDKFLCAVGNVLTAKYR

SEQ ID NO: 690 - protein, 332 aa, Cryptococcus albidus
MLSSTTLLAILSALALTSVQAAPADKNSLDYLANKAGKRYLGTAVQSPQLVPGSQYVQILESQFDAITPENEMKWEVVEPTEGNFDFTGTDKIVAEAKKTGSLLRGHNICWDSQLRYAHEVAPKMKLCINDYNIETVNAKSQAMAKVAAGLLAKGAPLHCIGMFKNAKRRSSGLLIRTASSGLESHFIGGSTPKDIPAAMNLFSDQGLEVPMTELDVRIPVNGNDMPANATVAKEQVDDYYTSVSACLGNDLCPGVSIWQFADPTSWIPGVFKGKLIAVSCTFSGCLLQYCVGYGAALLYDAQYQPKSTYYVVQQALKDGKNSGSKFHGIKL

SEQ ID NO: 691 - protein, 353 aa, Drosophila virilis
MAEKVNVCIVGSGNWGSAIAKIVGANAAALPEFEERVTMFVYEEMIDGKKLTEIINETHENVKYLKGHKLPTNVVAVPDLVEAAKNADILIFVVPHQFIPNFCKQLLGKIKPNAIAISLIKGFDKAEGGGIDLISHIITRHLKIPCAVLMGANLANEVAEGNFCETTIGCTDKKYGKVLRDLFQANHFRVVVVEDADAVEVCGALKNIVACGAGFVDGLKLGDNTKAAVIRLGLMEMIRFVDVFYPGSKLSTFFESCGVADLITTCYGGRNRRVSEAFVTSGKTIEDLEKEMLNGQKLQGPPTAEEVNYMLKNKGLEDKFPLFTAIHKICTNQLKPKDLIDCIRNHPEHMQTL

SEQ ID NO: 692 - protein, 413 aa, Mus musculus
MTPSISWGLLLLAGLCCLVPSFLAEDVQETDTSQKDQSPASHEIATNLGDFAISLYRELVHQSNTSNIFFSPVSIATAFAMLSLGSKGDTHTQILEGLQFNLTQTSEADIHKSFQHLLQTLNRPDSELQLSTGNGLFVNNDLKLVEKFLEEAKNHYQAEVFSVNFAESEEAKKVINDFVEKGTQGKIAEAVKKLDQDTVFALANYILFKGKWKKPFDPENTEEAEFHVDESTTVKVPMMTLSGMLHVHHCSTLSSWVLLMDYAGNATAVFLLPDDGKMQHLEQTLSKELISKFLLNRRRRLAQIHFPRLSISGEYNLKTLMSPLGITRIFNNGADLSGITEENAPLKLSQAVHKAVLTIDETGTEAAAVTVLQMVPMSMPPILRFDHPFLFIIFEEHTQSPIFLGKVVDPTHK

SEQ ID NO: 693 - protein, 418 aa, Mus musculus
MAFIVAMGMILMAGICPAVLCFPDGTKEMDIVFHEHQDNGTQDDSLTLASVNTDFAFSLYKKLALKNPDTNIVFSPLSISAALALVSLGAKGKTMEEILEGLKFNLTETPEADIHQGFGNLLQSLSQPEDQDQINIGNAMFIEKDLQILAEFHEKTRALYQTEAFTADFQQPTEAKNLINDYVSNQTQGMIKELISELDERTLMVLVNYIYFKGKWKISFDPQDTFESEFYLDEKRSVKVPMMKMKLLTTRHFRDEELSCSVLELKYTGNASALLILPDQGRMQQVEASLQPETLRKWRKTLFPSQIEELNLPKFSIASNYRLEEDVLPEMGIKEVFTEQADLSGITETKKLSVSQVVHKAVLDVAETGTEAAAATGVIGGIRKAILPAVHFNRPFLFVIYHTSAQSILFMAKVNNPK

SEQ ID NO: 694 - protein, 409 aa, Arbacia punctulata
MALGTRNMNMNLHGESKHTFNNENVSARLGGKSIAVQKPAQRAALGNISNVVRTAQAGSKKVVKKDTRQKAMTKTKATSSLHAVVGLPVEDLPTEMRSTSPDVLDAMEVDQAIEAFSQQLIALQVEDIDKDDGDNPQLCSEYAKDIYLYLRRLEVEMMVPANYLDRQETQITGRMRLILVDWLVQVHLRFHLLQETLFLTVQLIDRFLAEHSVSKGKLQLVGVTAMFIASKYEEMYPPEINDFVYITDNAYTKAQIRQMEIAMLKGLKYKLGKPLCLHFLRRNSKAAGVDAQKHTLAKYLMEITLPEYSMVQYSPSEIAAAAIYLSMTLLDPETHSSWCPKMTHYSMYSEDHLRPIVQKIVQILLRDDSASQKYSAVKTKYGSSKFMKISGIAQLDSSLLKQIAQGSNE

SEQ ID NO: 695 - protein, 77 aa, Plasmodium falciparum
LFGEHYVRVKSYCNDQSTGTLEIVSEDLSCLKGKHVLIVEDIIDTGKTLVKFCEYLKKFEIKTVAIACLFIKRTPLW

SEQ ID NO: 696 - protein, 99 aa, Plasmodium falciparum
ALLKHLSRIHNYSAVEMSKPLFGEHYVRVKSYCNDQSTGTLEIVSEDLSCLKGKHVLIVEDIIDTGKTLVKFCEYLKKFEIKTVAIACLFIKRTPLWNG

SEQ ID NO: 697 - protein, 354 aa, Ovis aries
AKPAAENLSLVVHGPGDLRLENYPIPEPGPNEVLLKMHSVGICGSDVHYWQGRIGDFVVKKPMVLGHEASGTVVKVGSLVRHLQPGDRVAIQPGAPRQTDEFCKIGRYNLSPTIFFCATPPDDGNLCRFYKHNANFCYKLPDNVTFEEGALIEPLSVGIHACRRAGVTLGNKVLVCGAGPIGLVNLLAAKAMGAAQVVVTDLSASRLSKAKEVGADFILEISNESPEEIAKKVEGLLGSKPEVTIECTGVETSIQAGIYATHSGGTLVLVGLGSEMTSVPLVHAATREVDIKGVFRYCNTWPMAISMLASKSVNVKPLVTHRFPLEKALEAFETSKKGLGLKVMIKCDPSDQNP

SEQ ID NO: 698 - protein, 543 aa, Bos taurus
MSLVASQSPLRNRVFVVGVGMTKFTKPGVENRDYPDLAKEAGQKALADAQIPYSAVEQACIGYVYGDSTSGQRAIYHSLGLTGIPIINVNNNCSTGSTALFMARQLIQGGLADCVLALGFEKMVKGPIAVNIQDKANPIDKHIEVMVNKYGLSPSPVAPQMFGNAGKEHMEKYGTTLEHFAKIGWKNHKHSVNNPYSQFQKEYSLDEVMTSRKIFDFLTVLQCCPTSDGAAAAILASEAFVQKHNLKPKAVEILAQEMVTDMPSSFEGKSIIKMVGFDMSKEAARRCYEKSGLRPSDIDVIELHDCFSANELITYEALGLCPEGQGGKLVERGDNTYGGKWVINPSGGLISKGHPLGATGLAQCVELCWHLRGEAGKRQVPGAKVALQHNIGIGGAVVVTLYKMGFPEAARTHQIEAAPTSSSVDGFKANLVFKEIEKKLEDEGEQFVKKIGGIFAFKVKDGPGGKEATWVVDVKNGKGSVLPNSDKKADCTITMADSDLLALMTGKMNPQTAFFQGKLKINGNMGLAMKLQNLQLQPGKAKL

SEQ ID NO: 699 - protein, 388 aa, Mus musculus
MTRDDALPDSHSAQTFYENYEPKEILGRGVSSVVRRCIHKPTCQEYAVKIIDITGGGSFSSEEVQELREATLKEVDILQKVSGHPNIIQLKDTYETNTFFFLVFDLMKRGELFDYLTEKVTLTEKETRKIMRALLEVICTLHKLNIVHRDLKPENILLDDNMNIKLTDFGFSCQLQPGEKLREVCGTPSYLAPEIIQCSMDDGHPGYGKEVDMWSTGVIMYTLLAGSPPFWHRKQMLMLRMIMDGKYQFGSPEWDDYSDTVKDLVSRFLVVQPQDRCSAEEALAHPFFQEYVVEEVRHFSPRGKFKVICLTVLASVKIYYQYRRVKPVTREIVIRDPYALRPLRRLIDAYAFRIYGHWVKKGQQQNRAALFENTPKAVLLSLAEEEDF

SEQ ID NO: 700 - protein, 316 aa, Rattus norvegicus
MASHLELNNGTKMPTLGLGTWKSPPGQVTEAVKVAIDMGYRHIDCAQVYQNEKEVGVALQEKLKEQVVKRQDLFIVSKLWCTFHDQSMVKGACQKTLSDLQLDYLDLYLIHWPTGFKPGPDYFPLDASGNVIPSDTDFVDTWTAMEQLVDEGLVKAIGVSNFNPLQIERILNKPGLKYKPAVNQIECHPYLTQEKLIEYCHCKGIVVTAYSPLGSPDRPWAKPEDPSLLEDPRIKEIAAKYNKTTAQVLIRFPIQRNLVVIPKSVTPARIAENFKVFDFELSNEDMATLLSYNRNWRVCALMSCAKHKDYPFHAEV

SEQ ID NO: 701 - protein, 158 aa, Rattus norvegicus
EKEVGVALQEKLKEQVVKRQDLFIVSKLWCTFHDQSMVKGACQKTLSDLQLDYLDLYLIHWPTGFKPGPDYFPLDASGNVIPSDTDFVDTWTAMEQLVDEGLVKAIGVSNFNPLQIERILNKPGLKYKPAVNQIECHPYLTQEKLIEYCHCKGIVVTA

SEQ ID NO: 702 - protein, 154 aa, Rattus norvegicus
VGVALQEKLKEQVVKRQDLFIVSKLWCTFHDQSMVKGACQKTLSDLQLDYLDLYLIHWPTGFKPGPDYFPLDASGNVIPSDTDFVDTWTAMEQLVDEGLVKAIGVSNFNPLQIERILNKPGLKYKPAVNQIECHPYLTQEKLIEYCHCKGIVVT

SEQ ID NO: 703 - protein, 424 aa, Saccharomyces cerevisiae
MSEATLSSKQTIEWENKYSAHNYHPLPVVFHKAKGAHVWDPEGKLYLDFLSAYSAVNQGHCHPHIIKALTEQAQTLTLSSRAFHNDVYAQFAKFVTEFFGFETVLPMNTGAEAVETALKLARRWGYMKKNIPQDKAIILGAEGNFHGRTFGAISLSTDYEDSKLHFGPFVPNVASGHSVHKIRYGHAEDFVPILESPEGKNVAAIILEPIQGEAGIVVPPADYFPKVSALCRKHNVLLIVDEIQTGIGRTGELLCYDHYKAEAKPDIVLLGKALSGGVLPVSCVLSSHDIMSCFTPGSHGSTFGGNPLASRVAIAALEVIRDEKLCQRAAQLGSSFIAQLKALQAKSNGIISEVRGMGLLTAIVIDPSKANGKTAWDLCLLMKDHGLLAKPTHDHIIRLAPPLVISEEDLQTGVETIAKCIDLL

SEQ ID NO: 704 - protein, 147 aa, Eulemur fulvus
MVHFTAEEKSTILSLWGKVNVEEAGGEALGRLLVVYPWTQRFFDNFGNLSSASAILGNPKVKAHGKKVLTSFGEAVKNMDNLKGAFAKLSELHCDKLHVDPENFKLLGNVMVIILATHFGKEFTPDVQAAWQKLVSGVATALAHKYH

SEQ ID NO: 705 - protein, 147 aa, Cheirogaleus medius
MVHFTVEEKAVITSLWGKVNVEEAGGEALGRLLVVYPWTQRFFDNFGNLSSASAIMGNPKVKAHGKKVLTSLGEAIKNMDDLKGTFAHLSELHCDRLHVDPENFKLLGNELVIVLAKHFGKEFTPQVQAAWQKMVAGVAIALAHKYH

SEQ ID NO: 706 - protein, 147 aa, Eulemur fulvus
MVHFTAEEKAVITSLWGKVNVEEAGGEALGRLLVVYPWTQRFFDNFGNLSSASAIMGNPKVKAHGKKVLTSLGDAIKNMDDLKGTFAHLSELHCDRLHVDPENFKLLGNELVIVLAKYFGKEFTPQVQAAWQKMVAGVAIALAHKYH

SEQ ID NO: 707 - protein, 338 aa, Mus musculus
MLSALARPAGAALRRSFSTSAQNNAKVAVLGASGGIGQPLSLLLKNSPLVSRLTLYDIAHTPGVAADLSHIETRANVKGYLGPEQLPDCLKGCDVVVIPAGVPRKPGMTRDDLFNTNATIVATLTAACAQHCPEAMVCIIANPVNSTIPITAEVFKKHGVYNPNKIFGVTTLDIVRANTFVAELKGLDPARVNVPVIGGHAGKTIIPLISQCTPKVDFPQDQLATLTGRIQEAGTEVVKAKAGAGSATLSMAYAGARFVFSLVDAMNGKEGVVECSFVQSKETECTYFSTPLLLGKKGLEKNLGIGKITPFEEKMIAEAIPELKASIKKGEDFVKNMK

SEQ ID NO: 708 - protein, 141 aa, Gyps rueppellii
VLSANDKTNVKNVFTKITGHAEDYGAETLERMFTTYPPTKTYFPHFDLHHGSAQIKAHGKKVVGALIEAVNHIDDIAGALSKLSDLHAQKLRVDPVNFKLLGQCFLVVVAIHHPSVLTPEVHASLDKFLCAVGNVLTAKYR

SEQ ID NO: 709 - protein, 125 aa, Saccharomyces cerevisiae
ALTQVCVQVMGNNAAITFAGSQGQFELNVFKPVMIANLLNSIRLITDAAYSFRVHCVEGIKANEPRIHELLTKSLMLVTALNPKIGYDAASKVAKNAHKKGITLKESALELGVLTEKEFDEWVVP

SEQ ID NO: 710 - protein, 122 aa, Saccharomyces cerevisiae
LTQVCVQVMGNNAAITFAGSQGQFELNVFKPVMIANLLNSIRLITDAAYSFRVHCVEGIKANEPRIHELLTKSLMLVTALNPKIGYDAASKVAKNAHKKGITLKESALELGVLTEKEFDEWV

SEQ ID NO: 711 - protein, 1588 aa, Saccharomyces cerevisiae
MVQLAKVPILGNDIIHVGYNIHDHLVETIIKHCPSSTYVICNDTNLSKVPYYQQLVLEFKASLPEGSRLLTYVVKPGETSKSRETKAQLEDYLLVEGCTRDTVMVAIGGGVIGDMIGFVASTFMRGVRVVQVPTSLLAMVDSSIGGKTAIDTPLGKNFIGAFWQPKFVLVDIKWLETLAKREFINGMAEVIKTACIWNADEFTRLESNASLFLNVVNGAKNVKVTNQLTNEIDEISNTDIEAMLDHTYKLVLESIKVKAEVVSSDERESSLRNLLNFGHSIGHAYEAILTPQALHGECVSIGMVKEAELSRYFGILSPTQVARLSKILVAYGLPVSPDEKWFKELTLHKKTPLDILLKKMSIDKKNEGSKKKVVILESIGKCYGDSAQFVSDEDLRFILTDETLVYPFKDIPADQQKVVIPPGSKSISNRALILAALGEGQCKIKNLLHSDDTKHMLTAVHELKGATISWEDNGETVVVEGHGGSTLSACADPLYLGNAGTASRFLTSLAALVNSTSSQKYIVLTGNARMQQRPIAPLVDSLRANGTKIEYLNNEGSLPIKVYTDSVFKGGRIELAATVSSQYVSSILMCAPYAEEPVTLALVGGKPISKLYVDMTIKMMEKFGINVETSTTEPYTYYIPKGHYINPSEYVIESDASSATYPLAFAAMTGTTVTVPNIGFESLQGDARFARDVLKPMGCKITQTATSTTVSGPPVGTLKPLKHVDMEPMTDAFLTACVVAAISHDSDPNSANTTTIEGIANQRVKECNRILAMATELAKFGVKTTELPDGIQVHGLNSIKDLKVPSDSSGPVGVCTYDDHRVAMSFSLLAGMVNSQNERDEVANPVRILERHCTGKTWPGWWDVLHSELGAKLDGAEPLECTSKKNSKKSVVIIGMRAAGKTTISKWCASALGYKLVDLDELFEQQHNNQSVKQFVVENGWEKFREEETRIFKEVIQNYGDDGYVFSTGGGIVESAESRKALKDFASSGGYVLHLHRDIEETIVFLQSDPSRPAYVEEIREVWNRREGWYKECSNFSFFAPHCSAEAEFQALRRSFSKYIATITGVREIEIPSGRSAFVCLTFDDLTEQTENLTPICYGCEAVEVRVDHLANYSADFVSKQLSILRKATDSIPIIFTVRTMKQGGNFPDEEFKTLRELYDIALKNGVEFLDLELTLPTDIQYEVINKRGNTKIIGSHHDFQGLYSWDDAEWENRFNQALTLDVDVVKFVGTAVNFEDNLRLEHFRDTHKNKPLIAVNMTSKGSISRVLNNVLTPVTSDLLPNSAAPGQLTVAQINKMYTSMGGIEPKELFVVGKPIGHSRSPILHNTGYEILGLPHKFDKFETESAQLVKEKLLDGNKNFGGAAVTIPLKLDIMQYMDELTDAAKVIGAVNTVIPLGNKKFKGDNTDWLGIRNALINNGVPEYVGHTAGLVIGAGGTSRAALYALHSLGCKKIFIINRTTSKLKPLIESLPSEFNIIGIESTKSIEEIKEHVGVAVSCVPADKPLDDELLSKLERFLVKGAHAAFVPTLLEAAYKPSVTPVMTISQDKYQWHVVPGSQMLVHQGVAQFEKWTGFKGPFKAIFDAVTKE

SEQ ID NO: 712 - protein, 142 aa, Accipiter gentilis
MVLSANDKTNVKNVFTKIGGHAEEYGAETLERMFTTYPPTKTYFPHFDLHHGSAQIKAHGKKVVGALIEAVNHIDDIAGALSKLSDLHAQKLRVDPVNFKLLGQCFLVVVAIHHPSVLTPEVHASLDKFLCAVGNVLTAKYR

SEQ ID NO: 713 - protein, 389 aa, Petunia hybrida
MVTVEEYRKAQRAEGPATVMAIGTATPTNCVDQSTYPDYYFRITNSEHKTDLKEKFKRMCEKSMIKKRYMHLTEEILKENPSMCEYMAPSLDARQDIVVVEVPKLGKEAAQKAIKEWGQPKSKITHLVFCTTSGVDMPGCDYQLTKLLGLRPSVKRLMMYQQGCFAGGTVLRLAKDLAENNKGARVLVVCSEITAVTFRGPNDTHLDSLVGQALFGDGAGAIIIGSDPIPGVERPLFELVSAAQTLLPDSHGAIDGHLREVGLTFHLLKDVPGLISKNIEKSLEEAFKPLGISDWNSLFWIAHPGGPAILDQVEIKLGLKPEKLKATRNVLSDYGNMSSACVLFILDEMRKASAKEGLGTTGEGLEWGVLFGFGPGLTVETVVLHSVAT

SEQ ID NO: 714 - protein, 418 aa, Rattus norvegicus
MTRLVTLELLMAGIGSALLCFPDCILGEDTLFHEDQDKGTQLDSLTLASINTDFAFSLYKKLALRNPDKNVVFSPLSISAALAVVSLGAKGNSMEEILEGLKFNLTETPETEIHRGFGHLLQRLSQPRDEIQISTGNALFIEKRLQVLAEFQEKAKALYQAEAFTADFQQSREAKKLINDYVSKQTQGKIQGLITNLAKKTSMVLVNYIYFKGKWKVPFDPRDTFQSEFYSGKRRPVKVPMMKLEDLTTPYVRDEELNCTVVELKYTGNASALFILPDQGKMQQVEASLQPETLRRWKDSLRPSMIDELYLPKFSISADYNLEDVLPELGIKEVFSTQADLSGITGDKDLMVSQVVHKAVLDVAETGTEAAAATGVKFVPMSAKLDPLIIAFDRPFLMIISDTETAIAPFLAKIFNPK

SEQ ID NO: 715 - protein, 417 aa, Mus musculus
MALSAKLTLDKVDLKGKRVIMRVDFNVPMKNNQITNNQRIKAAIPSIKHCLDNGAKSVVLMSHLGRPDGIPMPDKYSLEPVADELKSLLNKDVIFLKDCVGPEVEQACANPDNGSIILLENLRFHVEEEGKGKDSSGKKISADPAKVEAFQASLSKLGDVYVNDAFGTAHRAHSSTVGVNLPQKASGFLMKKELDYFSKALEKPERPFLAILGGAKVKDKIQLIKNMLDKVNFMIIGGGMAYTFLKELKNMQIGASLFDEEGATIVKEIMEKAEKNGVKIVFPVDFVTGDKFDENAKVGQATIESGIPSGWMGLDCGPESIKINAQIVAQAKLIVWNGPIGVFEWDAFAKGTKALMDEVVKATSNGCVTIIGGGDTATCCAKWGTEDKVSHVSTGGGASLELLEGKILPGVEALSNM

SEQ ID NO: 716 - protein, 363 aa, Rattus norvegicus
MAAQESLHVKTPLRDSMALSKVAGTSVFLKMDSSQPSGSFKIRGIGHLCKMKAKQGCKHFVCSSVVQIWGSRMRGRSHSGDEQPHVRSQALLPDTPSPLTAGNAGMATAYAARRLGLPATIVVPSTTPALTIERLKNEGATVEVVGEMLDEAIQLAKALEKNNPGWVYISPFDDPLIWEGHTSLVKELKETLSAKPGAIVLSVGGGGLLCGVVQGLREVGWEDVPIIAMETFGAHSFHAAVKEGKLVTLPKITSVAKALGVNTVGAQTLKLFYEHPIFSEVISDQEAVTAIEKFVDDEKILVEPACGAALAAVYSGVVCRLQAEGRLQTPLASLVVIVCGGSNISLAQLQALKAQLGLNELLK

SEQ ID NO: 717 - protein, 327 aa, Rattus norvegicus
MAAQESLHVKTPLRDSMALSKVAGTSVFLKMDSSQPSGSFKIRGIGHLCKMKAKQGCKHFVCSSAGNAGMATAYAARRLGLPATIVVPSTTPALTIERLKNEGATVEVVGEMLDEAIQLAKALEKNNPGWVYISPFDDPLIWEGHTSLVKELKETLSAKPGAIVLSVGGGGLLCGVVQGLREVGWEDVPIIAMETFGAHSFHAAVKEGKLVTLPKITSVAKALGVNTVGAQTLKLFYEHPIFSEVISDQEAVTAIEKFVDDEKILVEPACGAALAAVYSGVVCRLQAEGRLQTPLASLVVIVCGGSNISLAQLQALKAQLGLNELLK

SEQ ID NO: 718 - protein, 382 aa, Escherichia coli
MKALHFGAGNIGRGFIGKLLADAGIQLTFADVNQVVLDALNARHSYQVHVVGETEQVDTVSGVNAVSSIGDDVVDLIAQVDLVTTAVGPVVLERIAPAIAKGQVKRKEQGNESPLNIIACENMVRGTTQLKGHVMNALPEDAKAWVEEHVGFVDSAVDRIVPPSASATNDPLEVTVETFSEWIVDKTQFKGALPNIPGMELTDNLMAFVERKLFTLNTGHAITAYLGKLAGHQTIRDAILDEKIRAVVKGAMEESGAVLIKRYGFDADKHAAYIQKILGRFENPYLKDDVERVGRQPLRKLSAGDRLIKPLLGTLEYGLPHKNLIEGIAAAMHFRSEDDPQAQELAALIADKGPQAALAQISGLDANSEVVSEAVTAYKAMQ

SEQ ID NO: 719 - protein, 478 aa, Dictyostelium discoideum
MNIKELVLKLNEIDAIKLGEFKLKSGIISPIYIDLRVTVSSPPLLAAIAEMMYQKVYKSGNAQETPALVCGVPYTALPIATGMSIANNIPMVVRRKEAKAYGTKQLIEGRFKEGDNVLVVEDLVTSGASVLETVRDLNSVGLKVTDVVVLLDRQQGARQALEKQGYRLHSVFTMEELINTLIEAGKLTGRTLELVQSFLDANRNVVVPLPPTLAPPAPAPIVINKPFEERAKLASNPMASKLFTLMSSKKTNLAVAADLTDKQQLLDLAESIGSEICVLKTHVDIIDNYDEEFIKSLKCIAAKHNFLIFEDRKFADIGNTVKYQFENGVYKISKWADMVTVHGVAGSSIVDGFKSGLKEYGSGLLLLAQMSSKGSLCVGDYTTQMIEMANNNKEEVMGLICQERLPSMTDGLVLMTPGVQFNSTGDAMGQQYNTPEYIIKEKNTDVIIVGRGIYQSNDPKSVANKYRTAAWETYQSKF

SEQ ID NO: 720 - protein, 919 aa, Schizosaccharomyces pombe
MADNAGEYHDAEKHAPEQQAPPPQQPAHAAAPAQDDEPDDDIDALIEELFSEDVQEEQEDNDDAPAAGEAKAVPEELLQTDMNTGLTMSEVEERRKKYGLNQMKEELENPFLKFIMFFVGPIQFVMEMAAALAAGLRDWVDFGVICALLMLNAVVGFVQEYQAGSIVDELKKSLALKAVVIREGQVHELEANEVVPGDILKLDEGTIICADGRVVTPDVHLQVDQSAITGESLAVDKHYGDPTFASSGVKRGEGLMVVTATGDSTFVGRAASLVNAAAGGTGHFTEVLNGIGTILLVLVLLTLFCIYTAAFYRSVRLARLLEYTLAITIIGVPVGLPAVVTTTMAVGAAYLAEKQAIVQKLSAIESLAGVEVLCSDKTGTLTKNKLSLGEPFTVSGVSGDDLVLTACLAASRKRKGLDAIDKAFLKALKNYPGPRSMLTKYKVIEFQPFDPVSKKVTAYVQAPDGTRITCVKGAPLWVLKTVEEDHPIPEDVLSAYKDKVGDLASRGYRSLGVARKIEGQHWEIMGIMPCSDPPRHDTARTISEAKRLGLRVKMLTGDAVDIAKETARQLGMGTNIYNAERLGLTGGGNMPGSEVYDFVEAADGFGEVFPQHKYAVVDILQQRGYLVAMTGDGVNDAPSLKKADTGIAVEGATDAARSAADIVFLAPGLSAIIDALKTSRQIFHRMYSYVVYRIALSLHLEIFLGLWLIIRNQLLNLELVVFIAIFADVATLAIAYDNAPYSMKPVKWNLPRLWGLSTVIGIVLAIGTWITNTTMIAQGQNRGIVQNFGVQDEVLFLEISLTENWLIFVTRCNGPFWSSIPSWQLSGAVLAVDILATMFCIFGWFKGGHQTSIVAVLRIWMYSFGIFCIMAGTYYILSESAGFDRMMNGKPKESRNQRSIEDLVVALQRTSTRHEKGDA

SEQ ID NO: 721 - protein, 211 aa, Schistosoma mansoni
MAGEHIKVIYFDGRGRAESIRMTLVAAGVDYEDERISFQDWPKIKPTIPGGRLPAVKVTDDHGHVKWMLESLAIARYMAKKHHMMGETDEEYYSVEKLIGQAEDVEHEYHKTLMKPQEEKEKITKEILNGKVPVLLNMICESLKGSTGKLAVGDKVTLADLVLIAVIDHVTDLDKGFLTGKYPEIHKHRENLLASSPRLAKYLSNRPATPF

SEQ ID NO: 722 - protein, 161 aa, Escherichia coli
SIEDLAQLIFDLKQVNPKAMISVKLVSEPGVGTIATGVAKAYADLITIAGYDGGTGASPLSSVKYAGCPWELGLVETQQALVANGLRHKIRLQVDGGLKTGVDIIKAAILGAESFGFGTGPMVALGCKYLRICHLNNCATGVATQDDKLRKNHYHGLPFKV

SEQ ID NO: 723 - protein, 148 aa, Escherichia coli
LKQVNPKAMISVKLVSEPGVGTIATGVAKAYADLITIAGYDGGTGASPLSSVKYAGCPWELGLVETQQALVANGLRHKIRLQVDGGLKTGVDIIKAAILGAESFGFGTGPMVALGCKYLRICHLNNCATGVATQDDKLRKNHYHGLPF

SEQ ID NO: 724 - protein, 529 aa, Rattus norvegicus
MSMKQTSVFLLIQLICYFRPGACGKVLVWPTEYSHWINIKIILNELAQRGHEVTVLVSSASILIEPTKESSINFEIYSVPLSKSDLEYSFAKWIDEWTRDFETLSIWTYYSKMQKVFNEYSDVVENLCKALIWNKSLMKKLQGSQFDVILADAVGPCGELLAELLKTPLVYSLRFCPGYRCEKFSGGLPLPPSYVPVVLSELSDRMTFVERVKNMLQMLYFDFWFQPFKEKSWSQFYSDVLGRPTTLTEMMGKADIWLIRTFWDLEFPHPFLPNFDFVGGLHCKPAKPLPREMEEFVQSSGEHGVVVFSLGSMVKNLTEEKANVVASALAQIPQKVVWRFDGKKPDTLGSNTRLYKWIPQNDLLGHPKTKAFVAHGGTNGIYEAIYHGIPIVGIPLFADQPDNINHMVAKGAAVRVDFSILSTTGLLTALKIVMNDPSYKENAMRLSRIHHDQPVKPLDRAVFWIEYVMRHKGAKHLRSTLHDLSWFQYHSLDVIGFLLLCVVGVVFIITKFCLFCCRKTANMGKKKKE

SEQ ID NO: 725 - protein, 122 aa, Rattus norvegicus
VAKGAAVRVDFSILSTTGLLTALKIVMNDPSYKENAMRLSRIHHDQPVKPLDRAVFWIEYVMRHKGAKHLRSTLHDLSWFQYHSLDVIGFLLLCVVGVVFIITKFCLFCCRKTANMGKKKKE

SEQ ID NO: 726 - protein, 47 aa, Rattus norvegicus
TLHDLSWFQYHSLDVIGFLLLCVVGVVFIITKFCLFCCRKTANMGKK

SEQ ID NO: 727 - protein, 213 aa, Pseudomonas putida
MTITKKLSRTEMAQRVAADIQEGAYVNLGIGAPTLVANYLGDKEVFLHSENGLLGMGPSPAPGEEDDDLINAGKQHVTLLTGGAFFHHADSFSMMRGGHLDIAVLGAFQVSVKGDLANWHTGAEGSIPAVGGAMDLATGARQVFVMMDHLTKTGESKLVPECTYPLTGIACVSRIYTDLAVLEVTPEGLKVVEICADIDFDELQKLSGVPLIK

SEQ ID NO: 728 - protein, 48 aa, Salmonella typhimurium
TSKKTPRVGKLFLNWVTEDVIKQVIVNLYEFEKEMLGGKPIYLHMGHL

SEQ ID NO: 729 - protein, 50 aa, Salmonella typhimurium
TSKKTPRVGKLFLNWVTEDVIKQVIVNLYEFEKEMLGGKPIYLHMGHLID

SEQ ID NO: 730 - protein, 367 aa, Streptococcus pneumoniae
MKASPHRPTKALIHLGAIRQNIQQMGAHIPQGTLKLAVVKANAYGHGAVAVAKAIQDDVDGFCVSNIDEAIELRQAGLSKPILILGVSEIEAVALAKEYDFTLTVAGLEWIQALLDKEVDLTGLTVHLKIDSGMGRIGFREASEVEQAQDLLQQHGVCVEGIFTHFATADEESDDYFNAQLERFKTILASMKEVPELVHASNSATTLWHVETIFNAVRMGDAMYGLNPSGAVLDLPYDLIPALTLESALVHVKTVPAGACMGYGATYQADSEQVIATVPIGYADGWTRDMQNFSVLVDGQACPIVGRVSMDQITIRLPKLYPLGTKVTLIGSNGDKEITATQVATYRVTINYEVVCLLSDRIPREYY

SEQ ID NO: 731 - protein, 310 aa, Enterococcus faecalis
MGKKMVVALGGNAILSNDASAHAQQQALVQTSAYLVHLIKQGHRLIVSHGNGPQVGNLLLQQQAADSEKNPAMPLDTCVAMTQGSIGYWLSNALNQELNKAGIKKQVATVLTQVVVDPADEAFKNPTKPIGPFLTEAEAKEAMQAGAIFKEDAGRGWRKVVPSPKPIDIHEAETINTLIKNDIITISCGGGGIPVVGQELKGVEAVIDKDFASEKLAELVDADALVILTGVDYVCINYGKPDEKQLTNVTVAELEEYKQAGHFAPGSMLPKIEAAIQFVESQPNKQAIITSLENLGSMSGDEIVGTVVTK

SEQ ID NO: 732 - protein, 310 aa, Enterococcus faecium; identical to SEQ ID NO: 731

SEQ ID NO: 733 - protein, 163 aa, Thermosynechococcus elongatus
MLKKCVWLAVALCLCLWQFTMGTALAAELTPEVLTVPLNSEGKTITLTEKQYLEGKRLFQYACASCHVGGITKTNPSLDLRTETLALATPPRDNIEGLVDYMKNPTTYDGEQEIAEVHPSLRSADIFPKMRNLTEKDLVAIAGHILVEPKILGDKWGGGKVYY

SEQ ID NO: 734 - protein, 163 aa, Thermosynechococcus vulcanus; identical to SEQ ID NO: 733

SEQ ID NO: 735 - protein, 276 aa, Rhizobium radiobacter
MKLKTILCAALLLVAGQAAAQEKSITIATEGGYAPWNFSGPGGKLDGFEIDLANALCEKMKAKCQIVAQNWDGIMPSLTGKKYDAIMAAMSVTPKRQEVIGFSIPYAAGINGFAVMGDSKLAEMPGLGETYSLDSQADAAKKAIADISSFLNGTTVGVQGSTTASTFLDKYFKGSVDIKEYKSVEEHNLDLTSGRLDAVLANATVLAAAIEKPEMKGAKLVGPLFSGGEFGVVAVGLRKEDTALKADFDAAIKAASEDGTIKTLSLKWFKVDVTPQ

SEQ ID NO: 736 - protein, 156 aa, Escherichia coli
MRSSAKQEELVKAFKALLKEEKFSSQGEIVAALQEQGFDNINQSKVSRMLTKFGAVRTRNAKMEMVYCLPAELGVPTTSSPLKNLVLDIDYNDAVVVIHTSPGAAQLIARLLDSLGKAEGILGTIAGDDTIFTTPANGFTVKDLYEAILELFDQEL

SEQ ID NO: 737 - protein, 288 aa, Escherichia coli
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTVTDLADQQAFAEALASADILTNGTKVGMKPLENESLVNDISLLHPGLLVTECVYNPHMTKLLQQAQQAGCKTIDGYGMLLWQGAEQFTLWTGKDFPLEYVKQVMGFGA

SEQ ID NO: 738 - protein, 387 aa, Escherichia coli
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 739 - protein, 529 aa, Escherichia coli
MTLSPYLQEVAKRRTFAIISHPDAGKTTITEKVLLFGQAIQTAGTVKGRGSNQHAKSDWMEMEKQRGISITTSVMQFPYHDCLVNLLDTPGHEDFSEDTYRTLTAVDCCLMVIDAAKGVEDRTRKLMEVTRLRDTPILTFMNKLDRDIRDPMELLDEVENELKIGCAPITWPIGCGKLFKGVYHLYKDETYLYQSGKGHTIQEVRIVKGLNNPDLDAAVGEDLAQQLRDELELVKGASNEFDKELFLAGEITPVFFGTALGNFGVDHMLDGLVEWAPAPMPRQTDTRTVEASEDKFTGFVFKIQANMDPKHRDRVAFMRVVSGKYEKGMKLRQVRTAKDVVISDALTFMAGDRSHVEEAYPGDILGLHNHGTIQIGDTFTQGEMMKFTGIPNFAPELFRRIRLKDPLKQKQLLKGLVQLSEEGAVQVFRPISNNDLIVGAVGVLQFDVVVARLKSEYNVEAVYESVNVATARWVECADAKKFEEFKRKNESQLALDGGDNLAYIATSMVNLRLAQERYPDVQFHQTREH

SEQ ID NO: 740 - protein, 428 aa, Escherichia coli
MKTSLFKSLYFQVLTAIAIGILLGHFYPEIGEQMKPLGDGFVKLIKMIIAPVIFCTVVTGIAGMESMKAVGRTGAVALLYFEIVSTIALIIGLIIVNVVQPGAGMNVDPATLDAKAVAVYADQAKDQGIVAFIMDVIPASVIGAFASGNILQVLLFAVLFGFALHRLGSKGQLIFNVIESFSQVIFGIINMIMRLAPIGAFGAMAFTIGKYGVGTLVQLGQLIICFYITCILFVVLVLGSIAKATGFSIFKFIRYIREELLIVLGTSSSESALPRMLDKMEKLGCRKSVVGLVIPTGYSFNLDGTSIYLTMAAVFIAQATNSQMDIVHQITLLIVLLLSSKGAAGVTGSGFIVLAATLSAVGHLPVAGLALILGIDRFMSEARALTNLVGNGVATIVVAKWVKELDHKKLDDVLNNRAPDGKTHELSS

SEQ ID NO: 741 - protein, 93 aa, Escherichia coli
MAKTAAALHILVKEEKLALDLLEQIKNGADFGKLAKKHSICPSGKRGGDLGEFRQGQMVPAFDKVVFSCPVLEPTGPLHTQFGYHIIKVLYRN

SEQ ID NO: 742 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 743 - protein, 410 aa, Escherichia coli
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 744 - protein, 159 aa, Escherichia coli
MTPAVKLLEKNKISFQIHTYEHDPAETNFGDEVVKKLGLNPDQVYKTLLVAVNGDMKHLAVAVTPVAGQLDLKKVAKALGAKKVEMADPMVAQRSTGYLVGGISPLGQKKRLPTIIDAPAQEFATIYVSGGKRGLDIELAAGDLAKILDAKFADIARRD

SEQ ID NO: 745 - protein, 186 aa, Escherichia coli
MNKFLFAAALIVSGLLVGCNQLTQYTITEQEINQSLAKHNNFSKDIGLPGVADAHIVLTNLTSQIGREEPNKVTLTGDANLDMNSLFGSQKATMKLKLKALPVFDKEKGAIFLKEMEVVDATVQPEKMQTVMQTLLPYLNQALRNYFNQQPAYVLREDGSQGEAMAKKLAKGIEVKPGEIVIPFTD

SEQ ID NO: 746 - protein, 359 aa, Escherichia coli
MSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 747 - protein, 211 aa, Escherichia coli
MNKAKRLEILTRLRENNPHPTTELNFSSPFELLIAVLLSAQATDVSVNKATAKLYPVANTPAAMLELGVEGVKTYIKTIGLYNSKAENIIKTCRILLEQHNGEVPEDRAALEALPGVGRKTANVVLNTAFGWPTIAVDTHIFRVCNRTQFAPGKNVEQVEEKLLKVVPAEFKVDCHHWLILHGRYTCIARKPRCGSCIIEDLCEYKEKVDI

SEQ ID NO: 748 - protein, 287 aa, Escherichia coli
MAGAKEIRSKIASVQNTQKITKAMEMVAASKMRKSQDRMAASRPYAETMRKVIGHLAHGNLEYKHPYLEDRDVKRVGYLVVSTDRGLCGGLNINLFKKLLAEMKTWTDKGVQCDLAMIGSKGVSFFNSVGGNVVAQVTGMGDNPSLSELIGPVKVMLQAYDEGRLDKLYIVSNKFINTMSQVPTISQLLPLPASDDDDLKHKSWDYLYEPDPKALLDTLLRRYVESQVYQGVVENLASEQAARMVAMKAATDNGGSLIKELQLVYNKARQASITQELTEIVSGAAAV

SEQ ID NO: 749 - protein, 110 aa, Escherichia coli
MSFFISDAVAATGAPAQGSPMSLILMLVVFGLIFYFMILRPQQKRTKEHKKLMDSIAKGDEVLTNGGLVGRVTKVAENGYIAIALNDTTEVVIKRDFVAAVLPKGTMKAL

SEQ ID NO: 750 - protein, 236 aa, Escherichia coli
MKKGFMLFTLLAAFSGFAQADDAAIQQTLAKMGIKSSDIQPAPVAGMKTVLTNSGVLYITDDGKHIIQGPMYDVSGTAPVNVTNKMLLKQLNALEKEMIVYKAPQEKHVITVFTDITCGYCHKLHEQMADYNALGITVRYLAFPRQGLDSDAEKEMKAIWCAKDKNKAFDDVMAGKSVAPASCDVDIADHYALGVQLGVSGTPAVVLSNGTLVPGYQPPKEMKEFLDEHQKMTSGK

SEQ ID NO: 751 - protein, 232 aa, Escherichia coli
MKIGIIGAMEEEVTLLRDKIENRQTISLGGCEIYTGQLNGTEVALLKSGIGKVAAALGATLLLEHCKPDVIINTGSAGGLAPTLKVGDIVVSDEARYHDADVTAFGYEYGQLPGCPAGFKADDKLIAAAEACIAELNLNAVRGLIVSGDAFINGSVGLAKIRHNFPQAIAVEMEATAIAHVCHNFNVPFVVVRAISDVADQQSHLSFDEFLAVAAKQSSLMVESLVQKLAHG

SEQ ID NO: 752 - protein, 232 aa, Escherichia coli; identical to SEQ ID NO: 751

SEQ ID NO: 753 - protein, 452 aa, Streptococcus pyogenes
MKVISNFQNKKILILGLAKSGEAAAKLLTKLGALVTVNDSKPFDQNPAAQALLEEGIKVICGSHPVELLDEDFEYMVKNPGIPYDNPMVKRALAKEIPILTEVELAYFVSEAPIIGITGSNGKTTTTTMIADVLNAGGQSALLSGNIGYPASKVVQKAIAGDTLVMELSSFQLVGVNAFRPHIAVITNLMPTHLDYHGSFEDYVAAKWMIQAQMTESDYLILNANQEISATLAKTTQATVIPFSTQKVVDGAYLKDGILYFKEQAIIAATDLGVPGSHNIENALATIAVAKLSGIADDIIAQCLSHFGGVKHRLQRVGQIKDITFYNDSKSTNILATQKALSGFDNSRLILIAGGLDRGNEFDDLVPDLLGLKQMIILGESAERMKRAANKAEVSYLEARNVAEATELAFKLAQTGDTILLSPANASWDMYPNFEVRGDEFLATFDCLRGDA

SEQ ID NO: 754 - protein, 380 aa, Lactococcus lactis
MTSLKTKVIHGGISTDRTTGAVSVPIYQTSTYKQNGLGQPKEYEYSRSGNPTRHALEELIADLEGGVQGFAFSSGLAGIHAVLSLFSAGDHIILADDVYGGTFRLVDKVLTKTGIIYDLVDLSNLEDLKAAFKAETKAVYFETPSNPLLKVLDIKEISSIAKAHNALTLVDNTFATPYLQQPIALGADIVLHSATKYLGGHSDVVAGLVTTNSNELAIEIGFLQNSIGAVLGPQDSWLVQRGIKTLAPRMEAHSANAQKIAEFLEASQAVSKVYYPGLVNHEGHEIAKKQMTAFGGMISFELTDENAVKNFVENLRYFTLAESLGGVESLIEVPAVMTHASIPKELREEIGIKDGLIRLSVGVEALEDLLTDLKEALEKE

SEQ ID NO: 755 - protein, 654 aa, Arabidopsis thaliana
MNPSTPSLLYTSIFFYFTIIATQTLSLDPKFKACEPKSCGKGPQISYPFYLSGKQESFCGYPSFELTCDDEEKLPVLGISGEEYVIKNISYLTQSFQVVNSKASHDPCPRPLNNLTLHRTPFFVNPSHINFTILYNCSDHLLEDFRTYPLTCARNTSLLRSFGVFDRKKLGKEKQIASMSCQKLVDVPVLASNESDVMGMTYVEILKRGFVLNWTANSCFRCITSGGRCGTDQQEFVCLCPDGPKLHDTCTNGKNDKRRRVIVKITKSISGASAAVVGLIAASIFWYVYHRRKTKSYRNSSALLPRNISSDPSAKSFDIEKAEELLVGVHIFSYEELEEATNNFDPSKELGDGGFGTVYYGKLKDGRSVAVKRLYDNNFKRAEQFRNEVEILTGLRHPNLVALFGCSSKQSRDLLLVYEYVANGTLADHLHGPQANPSSLPWSIRLKIAVETASALKYLHASKIIHRDVKSNNILLDQNFNVKVADFGLSRLFPMDKTHVSTAPQGTPGYVDPDYHLCYQLSNKSDVYSFAVVLMELISSLPAVDITRPRQEINLSNMAVVKIQNHELRDMVDPSLGFDTDTRVRQTVIAVAELAFQCLQSDKDLRPCMSHVQDTLTRIQNNGFGSEMDVVDVNKSGPLVAQSPDSVIVKWDSK

SEQ ID NO: 756 - protein, 233 aa, Streptococcus pneumoniae
MREHRPIIALDFPSFEAVKEFLALFPAEESLYLKVGMELYYAAGPEIVSYLKGLGHSVFLDLKLHDIPNTVKSAMKILSQLGVDMTNVHAAGGVEMMKAAREGLGSQAKLIAVTQLTSTSEAQMQEFQNIQTSLQESVIHYAKKTAEAGLDGVVCSAQEVQVIKQATNPDFICLTPGIRPAGVAVGDQKRVMTPADAYQIGSDYIVVGRPITQAEDPVAAYHAIKDEWTQDWN

SEQ ID NO: 757 - protein, 121 aa, Mus musculus
MVQIVISSTGAEGLAEWVLMELQGEIEARYSTGLAGNLLGDLHYTTEGIPVLIVGHHILYGKTIHLEKPFAVLVKHTPGKQDCDEPGRGTGTQYLVTALIKNKILFKTRPKPIITNVPKKV

SEQ ID NO: 758 - protein, 70 aa, Cryptococcus neoformans
LTLSWPKPLVEFCNKAMILHQIEALVKAGVKDIVLAVNYRPEVMVSVLKKTEEEFGINIHFSVETEPLGT

SEQ ID NO: 759 - protein, 139 aa, Cryptococcus neoformans
MKALILVGGFGTRLRPLTLSWPKPLVEFCNKAMILHQIEALVKAGVKDIVLAVNYRPEVMVSVLKKTEEEFGINIHFSVETEPLGTAGPLALAREILGKDDSPFFVLNSDVTCVYPFEAFRDFHIAHKCEGSIMVTKVA

SEQ ID NO: 760 - protein, 760 aa, Arabidopsis thaliana
MAEGEESKKMNLQTSYFDVVGICCSSEVSIVGNVLRQVDGVKEFSVIVPSRTVIVVHDTFLISPLQIVKALNQARLEASVRPYGETSLKSQWPSPFAIVSGVLLVLSFFKYFYSPLEWLAIVAVVAGVFPILAKAVASVTRFRLDINALTLIAVIATLCMQDFTEAATIVFLFSVADWLESSAAHKASIVMSSLMSLAPRKAVIADTGLEVDVDEVGINTVVSVKAGESIPIDGVVVDGSCDVDEKTLTGESFPVSKQRESTVMAATINLNGYIKVKTTALARDCVVAKMTKLVEEAQKSQTKTQRFIDKCSRYYTPAVVVSAACFAVIPVLLKVQDLSHWFHLALVVLVSGCPCGLILSTPVATFCALTKAATSGFLIKTGDCLETLAKIKIVAFDKTGTITKAEFMVSDFRSLSPSINLHKLLNWVSSIECKSSHPMAAALIDYAISVSVEPKPDIVENFQNFPGEGVYGRIDGQDIYIGNKRIAQRAGCLTDNVPDIEATMKRGKTIGYIYMGAKLTGSFNLLDGCRYGVAQALKELKSLGIQTAMLTGDNQDAAMSTQEQLENALDIVHSELLPQDKARIIDDFKIQGPTMMVGDGLNDAPALAKADIGISMGISGSALATETGDIILMSNDIRKIPKGMRLAKRSHKKVIENVVLSVSIKGAIMVLGFVGYPLVWAAVLADAGTCLLVILNSMILLRDEREAVSTCYRSSTSSPVKLEEDEVEDLEVGLLQKSEETSKKSCCSGCCSGPKDNQQK

SEQ ID NO: 761 - protein, 185 aa, Arabidopsis thaliana
ALARDCVVAKMTKLVEEAQKSQTKTQRFIDKCSRYYTPAVVVSAACFAVIPVLLKVQDLSHWFHLALVVLVSGCPCGLILSTPVATFCALTKAATSGFLIKTGDCLETLAKIKIVAFDKTGTITKAEFMVSDFRSLSPSINLHKLLNWVSSIECKSSHPMAAALIDYAISVSVEPKPDIVENFQN

SEQ ID NO: 762 - protein, 96 aa, Arabidopsis thaliana
VIPVLLKVQDLSHWFHLALVVLVSGCPCGLILSTPVATFCALTKAATSGFLIKTGDCLETLAKIKIVAFDKTGTITKAEFMVSDFRSLSPSINLHK

SEQ ID NO: 763 - protein, 502 aa, Saccharomyces cerevisiae
MTKSDETTATSLNAKTLKSFESTLPIPTYPREGVKQGIVHLGVGAFHRSHLAVFMHRLMQEHHLKDWSICGVGLMKADALMRDAMKAQDCLYTLVERGIKDTNAYIVGSITAYMYAPDDPRAVIEKMANPDTHIVSLTVTENGYYHSEATNSLMTDAPEIINDLNHPEKPDTLYGYLYEALLLRYKRGLTPFTIMSCDNMPQNGVTVKTMLVAFAKLKKDEKFAAWIEDKVTSPNSMVDRVTPRCTDKERKYVADTWGIKDQCPVVAEPFIQWVLEDNFSDGRPPWELVGVQVVKDVDSYELMKLRLLNGGHSAMGYLGYLAGYTYIHEVVNDPTINKYIRVLMREEVIPLLPKVPGVDFEEYTASVLERFSNPAIQDTVARICLMGSGKMPKYVLPSIYEQLRKPDGKYKLLAVCVAGWFRYLTGVDMNGKPFEIEDPMAPTLKAAAVKGGKDPHELLNIEVLFSPEIRDNKEFVAQLTHSLETVYDKGPIAAIKEILDQV

SEQ ID NO: 764 - protein, 380 aa, Arabidopsis thaliana
MLPNEELVPVKRITPQSSWSWISIDATGKKTVLDVDKYVIMHRVQIHARDLRILDPNLFYPSAILGRERAIVLNLEHIKAIITAKEVLIQDSSDENLIPTLEEFQTRLSVGNKAHGGQLDGDVVEEDESAFEFRALEVALEAICSFLAARTIELEKSAYPALDELTLKLTSRNLLRVCKLKSSMTRLTAQVQKIKDELEQLLEDDEDMAELYLSRKLAGASSPAIDSGEHINWYPTSPTIGAKISRAKSHLVRSATVRGDDKNDVEEVEMLLEAHFMQIDRTLNKLTELREYVDETEDFLNIQLDSSRNQLIKFEIILTAGSICVSVYSVVVGILGMNIPFPWNIKKHMFKWVVSGTATVCAILFVTIMSFARYKKLFGF

SEQ ID NO: 765 - protein, 360 aa, Pisum sativum
MDFSTNGSEESELYHAQIHLYKHIYNFVSSMALKSAVELGIADAIHNHGKPMTLPELASSLKLHPSKVNILYRFLRLLTHNGFFAKTTVKSNGEEEETAYVLTPSSKLLVSGKSTCLSSVVKGALHPISLDLWGVSKKWFHEDKEQTLFECATGENYWDFLNKDSDYLSIFQDAMAADSRLFKLAIQENKHVFEGLESLVDVAGGTGGVAKLIHEAFPHIKCTVFDQPQVVGNLTGNENLNFVSGDMFKSVPSADAVLLKWVLHDWNDELSLKILKKSKEAISHKGKDGKVIIIDISIDDNSDDHGLTELQLEYDVVMLTMFLGKERTKKEWEKLIYDAGFSRYKITPICGFKSLIEVYP

SEQ ID NO: 766 - protein, 383 aa, Zymomonas mobilis
MASSTFYIPFVNEMGEGSLEKAIKDLNGSGFKNALIVSDAFMNKSGVVKQVADLLKAQGINSAVYDGVMPNPTVTAVLEGLKILKDNNSDFVISLGGGSPHDCAKAIALVATNGGEVKDYEGIDKSKKPALPLMSINTTAGTASEMTRFCIITDEVRHVKMAIVDRHVTPMVSVNDPLLMVGMPKGLTAATGMDALTHAFEAYSSTAATPITDACALKAASMIAKNLKTACDNGKDMPAREAMAYAQFLAGMAFNNASLGYVHAMAHQLGGYYNLPHGVCNAVLLPHVLAYNASVVAGRLKDVGVAMGLDIANLGDKEGAEATIQAVRDLAASIGIPANLTELGAKKEDVPLLADHALKDACALTNPRQGDQKEVEELFLSAF

SEQ ID NO: 767 - protein, 141 aa, Sphenodon punctatus
MLSASDKANVKAIWSKVCVHAEEYGAETLERMFTVYPSTKTYFPHFDLTHGSAQVKAHGKKVVNAMGEAVNHLDDMAGALLKLSDLHAQKLRVDPVNFKLLAQCFLVVLGVHHPAALTPEVHASLDKFLCAVGLVLTAKYR

SEQ ID NO: 768 - protein, 382 aa, Saccharomyces cerevisiae
MSSVTGFYIPPISFFGEGALEETADYIKNKDYKKALIVTDPGIAAIGLSGRVQKMLEERDLNVAIYDKTQPNPNIANVTAGLKVLKEQNSEIVVSIGGGSAHDNAKAIALLATNGGEIGDYEGVNQSKKAALPLFAINTTAGTASEMTRFTIISNEEKKIKMAIIDNNVTPAVAVNDPSTMFGLPPALTAATGLDALTHCIEAYVSTASNPITDACALKGIDLINESLVAAYKDGKDKKARTDMCYAEYLAGMAFNNASLGYVHALAHQLGGFYHLPHGVCNAVLLPHVQEANMQCPKAKKRLGEIALHFGASQEDPEETIKALHVLNRTMNIPRNLKELGVKTEDFEILAEHAMHDACHLTNPVQFTKEQVVAIIKKAYEY

SEQ ID NO: 769 - protein, 257 aa, Bacillus sp.
MKKNTLLKVGLCVSLLGTTQFVSTISSVQASQKVEQIVIKNETGTISISQLNKNVWVHTELGYFNGEAVPSNGLVLNTSKGLVLVDSSWDNKLTKELIEMVEKKFQKRVTDVIITHAHADRIGGITALKERGIKAHSTALTAELAKKSGYEEPLGDLQTVTNLKFGNTKVETFYPGKGHTEDNIVVWLPQYQILAGGCLVKSAEAKNLGNVADAYVNEWSTSIENMLKRYRNINLVVPGHGKVGDKGLLLHTLDLLK

SEQ ID NO: 770 - protein, 34 aa, Rattus norvegicus
FKYQSLLTKNKARVVILMVWIVSGLTSFLPIQMH

SEQ ID NO: 771 - protein, 61 aa, Rattus norvegicus
QVEQDGRSGHGLRSSSKFCLKEHKALKTLGIIMGTFTLCWLPFFIVNIVHVIRANLIPKEV

SEQ ID NO: 772 - protein, 432 aa, Rattus norvegicus
MADKLPYKVADIGLAAWGRKALDIAENEMPGLMRMREMYSASKPLKGARIAGCLHMTVETAVLIETLVALGAEVRWSSCNIFSTQDHAAAAIAKAGIPVFAWKGETDEEYLWCIEQTLHFKDGPLNMILDDGGDLTNLIHTKHPQLLSGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYLLKNGHRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 773 - protein, 142 aa, Triturus cristatus
MKLSADDKHNVKAIWEHVKGHEEAIGAEALCRMFTSLPTTRTYFPTKDIKEGSSFLHSHGKKVMGALSNAVAHIDDIDGALSKLSDKHAEELMVDPANFPKLAHNILVVLGIHLKPHLTYSVHSSVDKFLATVGYVLASKYR

SEQ ID NO: 774 - protein, 431 aa, Dictyostelium discoideum
MTKLHYKVKDISLAAWGRKEIEIAENEMPGLMTLRKKYGPAQILKGARIAGCLHMTIQTAVLIETLTALGAQVQWSSCNIFSTQDQAAAAIAATGVPVYAWKGETEEEYNWCVEQTIVFQDGQPLNMILDDGGDLTNLVHEKYPQFLAGIKGISEETTTGVHNLYKMFKEGKLKVPAINVNDSVTKSKFDNLYGCRESLIDGIKRATDVMIAGKVAVVAGYGDVGKGCAQSLSKMGARVLVTEIDPINALQACMDGYQIVTMETAAPLSNIFVTTTGCRDIVRGEHFAVMKEDAIVCNIGHFDCEIDVAWLNANAKKDTVKPQVDRYTLANGVHIILLAEGRLVNLGCGTGHPSFVMSNSFCNQTLAQIALWTKTEEYPLGVHFLPKILDEEVARLHLDQLGAKLTTLTEKQSEYLSVPVAGPYKVDHYRY

SEQ ID NO: 775 - protein, 1086 aa, Bos taurus
MANLLKTVVTGCSCPFLSNLGSCKVLPGKKNFLRTFHTHRILWCSAPVKPGIPYKQLTVGVPKEIFQNEKRVALSPAGVQALVKQGFNVVVESGAGEASKFSDDHYRAAGAQIQGAKEVLASDLVVKVRAPMLNPTLGVHEADLLKTSGTLISFIYPAQNPDLLNKLSKRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPILFNKEMIESMKEGSVVVDLAAEAGGNFETTKPGELYVHKGITHIGYTDLPSRMATQASTLYSNNITKLLKAISPDKDNFYFEVKDDFDFGTMGHVIRGTVVMKDGQVIFPAPTPKNIPQGAPVKQKTVAELEAEKAATITPFRKTMTSASVYTAGLTGILGLGIAAPNLAFSQMVTTFGLAGIVGYHTVWGVTPALHSPLMSVTNAISGLTAVGGLVLMGGHLYPSTTSQGLAALATFISSVNIAGGFLVTQRMLDMFKRPTDPPEYNYLYLLPAGTFVGGYLASLYSGYNIEQIMYLGSGLCCVGALAGLSTQGTARLGNALGMIGVAGGLAATLGGLKPCPELLAQMSGAMALGGTIGLTIAKRIQISDLPQLVAAFHSLVGLAAVLTCIAEYIIEYPHFATDAAANLTKIVAYLGTYIGGVTFSGSLVAYGKLQGILKSAPLLLPGRHLLNAGLLAGSVGGIIPFMMDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLSEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 776 - protein, 143 aa, Salmo salar
MSLTARDKSVVNAFWGKIKGKADVVGAEALGRMLTAYPQTKTYFSHWADLSPGSAPVKKHGGVIMGAIGNAVGLMDDLVGGMSGLSDLHAFKLRVDPGNFKILSHNILVTLAIHFPADFTPEVHIAVDKFLAALSAALADKYR

SEQ ID NO: 777 - protein, 123 aa, Drosophila melanogaster
GPVAVKTLNVKTPSPAQLQAFKNEVAMLKKTRHCNILLFMGCVSKPSLAIVTQWCEGSSLYKHVHVSETKFKLNTLIDIGRQVAQGMDYLHAKNIIHRDLKSNNIFLHEDLSVKIGDFGLATA

SEQ ID NO: 778 - protein, 42 aa, Drosophila melanogaster
ILLFMGCVSKPSLAIVTQWCEGSSLYKHVHVSETKFKLNTLI

SEQ ID NO: 779 - protein, 123 aa, Drosophila melanogaster; identical to SEQ ID NO: 777

SEQ ID NO: 780 - protein, 42 aa, Drosophila melanogaster; identical to SEQ ID NO: 778

SEQ ID NO: 781 - protein, 101 aa, Mus musculus
MKLLLLLCLELTLVCVHAEEASSERQNFNVEKINGKWFSILLASDKREKIEEHGTMRVFVEHIDVLENSLAFKFHTVIDEECTEIYLVADKTEKAGEYSVT

SEQ ID NO: 782 - protein, 92 aa, Mus musculus
MKLLLLLCLELTLVCVHAEEASSERQNFNVEKINGKWFSILLASDKREKIEEHGTMRVFVEHIDVLENSLAFKFHTVIDEECTEIYLVADKT

SEQ ID NO: 783 - protein, 120 aa, Canis familiaris
IPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVV

SEQ ID NO: 784 - protein, 113 aa, Canis familiaris
KAILALLGVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGH

SEQ ID NO: 785 - protein, 334 aa, Sus scrofa
MSEPIRVLVTGAAGQIAYSLLYSIGNGSVFGKDQPIILVLLDITPMMGVLDGVLMELQDCALPLLKDVIATDKEEIAFKDLDVAILVGSMPRRDGMERKDLLKANVKIFKCQGAALDKYAKKSVKVIVVGNPANTNCLTASKSAPSIPKENFSCLTRLDHNRAKAQIALKLGVTSDDVKNVIIWGNHSSTQYPDVNHAKVKLQAKEVGVYEAVKDDSWLKGEFITTVQQRGAAVIKARKLSSAMSAAKAICDHVRDIWFGTPEGEFVSMGIISDGNSYGVPDDLLYSFPVTIKDKTWKIVEGLPINDFSREKMDLTAKELAEEKETAFEFLSSA

SEQ ID NO: 786 - protein, 974 aa, Leishmania donovani
MSSKKYELDAAAFEDKPESHSDAEMTPQKPQRRQSVLSKAVSEHDERATGPATDLLPPSKGLTTEEAEELLKKYGRNELPEKKTPSWLIYVRGLWGPMPAALWIAIIIEFALENWPDGAILFAIQIANATIGWYETIKAGDAVAALKNSLKPTATVYRDSKWQQIDAAVLVPGDLVKLASGSAVPADCSINEGVIDVDEAALTGESLPVTMGPEHMPKMGSNVVRGEVEGTVQYTGSLTFFGKTAALLQSVESDLGNIHVILRRVMFSLCAISFMLCMCCFIYLLARFYETFRHALQFAVVVLVVSIPIALEIVVTTTLAVGSKHLSKHKIIVTKLSAIEMMSGVNMLCSDKTGTLTLNKMEIQEQCFTFEEGNDLKSTLVLAALAAKWREPPRDALDTMVLGAADLDECDNYQQLNFVPFDPTTKRTAATLVDRRSGEKFDVTKGAPHVILQMVYNQDEINDEVVDIIDSLAARGVRCLSVAKTDQQGRWHMAGILTFLDPPRPDTKDTIRRSKEYGVDVKMITGDHLLIAKEMCRMLDLDPNILTADKLPQIKDANDLPEDLGEKYGDMMLSVGGFAQVFPEHKFMIVETLRQRGYTCAMTGDGVNDAPALKRADVGIAVHGATDAARAAADMVLTEPGLSVVVEAMLVSREVFQRMLSFLTYRISATLQLVCFFFIACFSLTPKAYGSVDPHFQFFHLPVLMFMLITLLNDGCLMTIGYDHVIPSERPQKWNLPVVFVSASILAAVACGSSLMLLWIGLEGYSSQYYENSWFHRLGLAQLPQGKLVTMMYLKISISDFLTLFSSRTGGHFFFYMPPSPILFCGAIISLLVSTMAASFWHKSRPDNVLTEGLAWGQTNAEKLLPLWVWIYCIVWWFVQDVVKVLAHICMDAVDLFGCVSDASGSGPIKPYSDDMKVNGFEPVKKPAEKSTEKALNSSVSSASHKALEGLREDTHSPIEEASPVNVYVSRDQK

SEQ ID NO: 787 - protein, 102 aa, Leishmania donovani
FYETFRHALQFAVVVLVVSIPIALEIVVTTTLAVGSKHLSKHKIIVTKLSAIEMMSGVNMLCSDKTGTLTLNKMEIQEQCFTFEEGNDLKSTLVLAALAAKW

SEQ ID NO: 788 - protein, 111 aa, Leishmania donovani
FYETFRHALQFAVVVLVVSIPIALEIVVTTTLAVGSKHLSKHKIIVTKLSAIEMMSGVNMLCSDKTGTLTLNKMEIQEQCFTFEEGNDLKSTLVLAALAAKWREPPRDALD

SEQ ID NO: 789 - protein, 639 aa, Glycine max
MMRARFPLLLLGVVFLASVSVSFGIAYWEKQNPSHNKCLRSCNSEKDSYRNQACHARCNLLKVEEEEECEEGQIPRPRPQHPERERQQHGEKEEDEGEQPRPFPFPRPRQPHQEEEHEQKEEHEWHRKEEKHGGKGSEEEQDEREHPRPHQPHQKEEEKHEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTFYVVNPDNDENLRMIAGTTFYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLGSRDPIYSNKLGKLFEITQRNPQLRDLDVFLSVVDMNEGALFLPHFNSKAIVVLVINEGEANIELVGIKEQQQRQQQEEQPLEVRKYRAELSEQDIFVIPAGYPVMVNATSDLNFFAFGINAENNQRNFLAGSKDNVISQIPSQVQELAFPRSAKDIENLIKSQSESYFVDAQPQQKEEGNKGRKGPLSSILRAFY

SEQ ID NO: 790 - protein, 180 aa, Glycine max
WQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTFYVVNPDNDENLRMIAGTTFYVVNPDNDENLRM

SEQ ID NO: 791 - protein, 556 aa, Caenorhabditis elegans
MFVFRVLNTVPYTNRTGAKDLVASIHSFLTSNLLVGLAVLISWKQFGGTPIECMVPLDFTSAWVQYSNNYCWAQPTYFIPFTEELVEQVVDPADVVADGITIGNGGNRPRFVKKGGEKISYYQWMSFFLLFEAACFRLPCFIWKYFASQSGMQVGEILRVASDENNAVPLVKKANIDALCIHLRGVLRFQKRLKLKKIVPHKILRFLNIKYSAYYVTFIYFVAKVAFLLNVILQSKLLNKYMLPHDRQQNFGFDMWKTIFYGSTNGNETWRENGVFPRVTLCDFETRDMGNVQMHTVQCVLLLNLFTEKIFVFLWAWYILLTAFTVGNLFSWLFAVFNETYNEHFILNHLEMCETPFDKDDLKNREHVTRFITLYLGTDGLFLLQLIAQHADVVFTTELIAALFKTYIEIEAQRATLKQMNAVLPLLRPNDESQVESGKNTAPSTSHNVRRRGTEQLEKNVKSRQGSLSTQLRPFNSFEEPDQPTKKFDDSSSEDENSKKGSKKPSPTKKKASSKNSPQSSSNSRRPSLAHTASPAFTHHHEPDSKIPKTAEKKHW

SEQ ID NO: 792 - protein, 152 aa, Xenopus laevis
EFLIGYIIPAVCIGVSFLVFLCGKTVFVTKPADGSAFTDMVKILAYFCCSRKHTRENTRNIQNNQHRHKQSRLDMAKASHGGPFREDKVEDVKALVKIIPVFLALIPYWTVYFQMQTTYVLQSLHLRIPQIFNNNHTLPAAWLTMFDAVLIL

SEQ ID NO: 793 - protein, 547 aa, Rattus norvegicus
MPSVALNSPRLPRVFVVGVGMTKFMKPGGENSRDYPDLAKEAGQKALADRQIPYSAVEQACVGYVYGESTCGQRAIYHSLGLTGIPIINVNNNCSTGSTALFMAQQLVQGGLANCVLALGFEKMEKGSLGTKYSDRSNPLEKHIDVLINKYGMSACPFAPQLFGSAGKEHMETYGTKVEHFAKIGWKNHKHSVNNPYSQFQDEYSLDEIMKSRPVFDFLTVLQCCPTSDGAAAAIVSSEEFVQKHGLQSKAVEIVAQEMVTDMPSTFEEKSVIKMVGYDMSKEAARKCYEKSGLGPSDVDVIELHDCFSTNELLTYEALGLCPEGQGGALVDRGDNTYGGKWVINPSGGLISKGHPLGATGLAQCAELCWQLRGEAGKRQVPGAKVALQHNLGLGGAAVVTLYRMGFPEAASSFRTHQISAAPTSSAGDGFKANLIFKEIEKKLEEEGEEFVKKIGGIFAFKVKDGPGGKEATWVVDVKNGKGSVLPDSDKKADCTITMADSDLLALMTGKMNPQSAFFQGKLKIAGNMGLAMKLQSLQLQPDKAKL

SEQ ID NO: 794 - protein, 119 aa, Salmonella typhi
MNLSFAKGGLPAPVKNRAWQYCQMAWRGVTSKKALSRLAALSPLLLLGVGQMASATDLLAGGKDDVKATFGADSFVMMCIIIAELIVGVAMYIRTKNLLILLGLVVVIVFTTVGLTFIK

SEQ ID NO: 795 - protein, 73 aa, Gallus gallus
EQVGVNLNGPMKSVEFSYKGVDGSLQTASFLHLPFLFDSQWHKLMISVETTSVTLFIDCIKVETLNIKPKGKI

SEQ ID NO: 796 - protein, 66 aa, Gallus gallus
VNLNGPMKSVEFSYKGVDGSLQTASFLHLPFLFDSQWHKLMISVETTSVTLFIDCIKVETLNIKPK

SEQ ID NO: 797 - protein, 157 aa, Rattus norvegicus
MDTGGSARLCLALVLISLGVMLTATQKSVVSLDPPWIRILTGDKVTLICNGNNSSQMNSTKWIHNDSISNVKSSHWVIVSATIQDSGKYICQKQGFYKSKPVYLNVMQEWLLLQSSADVVLDNGSFDIRCRSWKKWKVHKITQLSIVGYNSFSHHWR

SEQ ID NO: 798 - protein, 46 aa, Gallus gallus
HLLMTVGDIFGAGVETTTTVLKWAVLYLLHYPEVQKKIQEEMDQKI

SEQ ID NO: 799 - protein, 54 aa, Gallus gallus
LMTVGDIFGAGVETTTTVLKWAVLYLLHYPEVQKKIQEEMDQKIGLARHPHLSD

SEQ ID NO: 800 - protein, 974 aa, Leishmania donovani
MSSKKYELDAAAFEDKPESHSDAEMTPQKPQRRQSVLSKAVSEHDERATGPATDLLPPSKGLTTEEAEELLKKYGRNELPEKKTPSWLIYVRGLWGPMPAALWIAIIIEFALENWPDGAILFAIQIANATIGWYETIKAGDAVAALKNSLKPTATVYRDSKWQQIDAAVLVPGDLVKLASGSAVPADCSINEGVIDVDEAALTGESLPVTMGPEHMPKMGSNVVRGEVEGTVQYTGSLTFFGKTAALLQSVESDLGNIHVILRRVMLALCAISFILCMCCFIYLLARFYETFRHALQFAVVVLVVSIPIALEIVVTTTLAVGSKHLSKHKIIVTKLSAIEMMSGVNMLCSDKTGTLTLNKMEIQEQCFTFEEGNDLKSTLVLAALAAKWREPPRDALDTMVLGAADLDECDNYQQLNFVPFDPTTKRTAATLVDRRSGEKFDVTKGAPHVILQMVYNQDEINDEVVDIIDSLAARGVRCLSVAKTDQQGRWHMAGILTFLDPPRPDTKDTIRRSKEYGVDVKMITGDHLLIAKEMCRMLDLDPNILTADKLPQIKDANDLPEDLGEKYGDMMLSVGGFAQVFPEHKFMIVETLRQRGYTCAMTGDGVNDAPALKRADVGIAVHGATDAARAAADMVLTEPGLSVVVEAMLVSREVFQRMLSFLTYRISATLQLVCFFFIACFSLTPKAYGSVDPNFQFFHLPVLMFMLITLLNDGCLMTIGYDHVIPSERPQKWNLPVVFVSASILAAVACGSSLMLLWIGLEGYSSQYYENSWFHRLGLAQLPQGKLVTMMYLKISISDFLTLFSSRTGGHFFFYVPPSPILFCGAIISLLVSTMAASFWHKSRPDNVLTEGLAWGQTNAEKLLPLWVWIYCIVWWFVQDVVKVLAHICMDAVDLFGCVSDASGSGPIKPYSDDMKVNGFEPVKKPAEKSTEKALNLSVSSGPHKALEGLREDTHVLNESTSPVNAFSPKVKK

SEQ ID NO: 801 - protein, 102 aa, Leishmania donovani; identical to SEQ ID NO: 787

SEQ ID NO: 802 - protein, 111 aa, Leishmania donovani; identical to SEQ ID NO: 788

SEQ ID NO: 803 - protein, 214 aa, Zea mays
MAPMKLYGAVMSWNLTRCATALEEAGSDYEIVPINFATAEHKSPEHLVRNPFGQVPALQDGDLYLFESRAICKYAARKNKPELLREGNLEEAAMVDVWIEVEANQYTAALNPILFQVLISPMLGGTTDQKVVDENLEKLKKVLEVYEARLTKCKYLAGDFLSLADLNHVSVTLCLFATPYASVLDAYPHVKAWWSGLMERPSVQKVAALMKPSA

SEQ ID NO: 804 - protein, 416 aa, Ovis aries
MALSITRGLLLLAALCCLAPTSLAGVLQGHAVQETDDTAHQEAACHKIAPNLANFAFSIYHKLAHQSNTSNIFFSPVSIASAFAMLSLGAKGNTHTEILEGLGFNLTELAEAEIHKGFQHLLHTLNQPNHQLQLTTGNGLFINESAKLVDTFLEDVKNLHHSKAFSINFRDAEEAKKKINDYVEKGSHGKIVDLVKDLDQDTVFALVNYISFKGKWEKPFEVEHTTERDFHVNEQTTVKVPMMNRLGMFDLHYCDKLASWVLLLDYVGNVTACFILPDLGKLQQLEDKLNNELLAKFLEKKYASSANLHLPKLSISETYDLKTVLGELGINRVFSNGADLSGITEEQPLMVSKALHKAALTIDEKGTEAAGATFLEAIPMSLPPDVEFNRPFLCILYDRNTKSPLFVGKVVNPTQA

SEQ ID NO: 805 - protein, 401 aa, Triticum aestivum
MATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 806 - protein, 395 aa, Arabidopsis thaliana
MVMAGASSLDEIRQAQRADGPAGILAIGTANPENHVLQAEYPDYYFRITNSEHMTDLKEKFKRMCDKSTIRKRHMHLTEEFLKENPHMCAYMAPSLDTRQDIVVVEVPKLGKEAAVKAIKEWGQPKSKITHVVFCTTSGVDMPGADYQLTKLLGLRPSVKRLMMYQQGCFAGGTVLRIAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIVKSLDEAFKPLGISDWNSLFWIAHPGGPAILDQVEIKLGLKEEKMRATRHVLSEYGNMSSACVLFILDEMRRKSAKDGVATTGEGLEWGVLFGFGPGLTVETVVLHSVPL

SEQ ID NO: 807 - protein, 397 aa, Xenopus laevis
MSLRVTRNMLANAENNVKTTLAGKRVVATKPGLRPRTALGDIGNKAEVKVPTKKELKPAVKAAKKAKPVDKLLEPLKVIEENVCPKPAQVEPSSPSPMETSGCLPDELCQAFSDVLIHVKDVDADDDGNPMLCSEYVKDIYAYLRSLEDAQAVRQNYLHGQEVTGNMRAILIDWLVQVQMKFRLLQETMFMTVGIIDRFLQEHPVPKNQLQLVGVTAMFLAAKYEEMYPPEIGDFTFVTDHTYTKAQIRDMEMKILRVLKFAIGRPLPLHFLRRASKIGEVTAEQHSLAKYLMELVMVDYDMVHFTPSQIAAASSCLSLKILNAGDWTPTLHHYMAYSEEDLVPVMQHMAKNIIKVNKGLTKHLTVKNKYASSKQMKISTIPQLRSDVVVEMARPLM

SEQ ID NO: 808 - protein, 392 aa, Xenopus laevis
MATRRAAIPREADNILGGAMRSKVQMNSRRAALGEIGNKVTVRGKPPAVKQSSNAVAKPSKMAATKVANVKTKHVPVKPVVAEAAPKVPSPVPMDVSLKEEELCQAFSDALTSVEDIDADDGGNPQLCSDYVMDIYNYLKQLEVQQSVHPCYLEGKEINERMRAILVDWLVQVHSRFQLLQETLYMGVAIMDRFLQVQPVSRSKLQLVGVTSLLIASKYEEMYTPEVADFVYITDNAYTASQIREMEMIILRLLNFDLGRPLPLHFLRRASKSCSADAEQHTLAKYLMELTLIDYEMVHIKPSEIAAAALCLSQKILGQGTWGTTQHYYTGYTEGDLQLIMKHMAKNITKVNQNLTKHVAVRNKYASSKLMKISTLPQLMAPLITELAASLS

SEQ ID NO: 809 - protein, 248 aa, Mus musculus
MPPILILLTLLLPLRAGAEEIIGGHEVKPHSRPYMAFIKSVDIEGKKKYCGGFLVQDDFVLTAAHCRNRSMTVTLGAHNIKAKEETQQIIPVAKAIPHPAFNRKHGTNDIMLLKLESKAKRTKAVRPLKLPRPNARVKPGDVCSVAGWGKTSINATKASARLREAQLIIQEDEECKKLWYTYSKTTQICAGDPKKVQAPYEGESGGPLVCDNLAYGVVSYGINRTITPGVFTKVVHFLPWISTNMKLL

SEQ ID NO: 810 - protein, 703 aa, Gallus gallus
MGVRSPLSASGPRGAAVLVLLLLGVALCSAVEEKKVCQGTNNKLTQLGHVEDHFTSLQRMYNNCEVVLSNLEITYVEHNRDLTFLKTIQEVAGYVLIALNMVDVIPLENLQIIRGNVLYDNSFALAVLSNYHMNKTQGLRELPMKRLSEILNGGVKISNNPKLCNMDTVLWNDIIDTSRKPLTVLDFASNLSSCPKCHPNCTEDHCWGAGEQNCQTLTKVICAQQCSGRCRGKVPSDCCHNQCAAGCTGPRESDCLACRKFRDDATCKDTCPPLVLYNPTTYQMDVNPEGKYSFGATCVRECPHNYVVTDHGSCVRSCNTDTYEVEENGVRKCKKCDGLCSKVCNGIGIGELKGILSINATNIDSFKNCTKINGDVSILPVAFLGDAFTKTLPLDPKKLDVFRTVKEISGFLLIQAWPDNATDLYAFENLEIIRGRTKQHGQYSLAVVNLKIQSLGLRSLKEISDGDIAIMKNKNLCYADTMNWRSLFATQSQKTKIIQNRNKNDCTADRHVCDPLCSDVGCWGPGPFHCFSCRFFSRQKECVKQCNILQGEPREFERDSKCLPCHSECLVQNSTAYNTTCSGPGPDHCMKCAHFIDGPHCVKACPAGVLGENDTLVWKYADANAVCQLCHPNCTRGCKGPGLEGCPNGSKTPSIAAGVVGGLLCLVVVGLGIGLYLRRRHIVRKRTLRRLLQERELVEPLTP

SEQ ID NO: 811 - protein, 395 aa, Sinapis alba
MVMGTPSSLDEIRKAQRADGPAGILAIGTANPANHVIQAEYPDYYFRITNSEHMTDLKEKFKRMCDKSTIRKRHMHLTEEFLKDNPNMCAYMAPSLDARQDIVVVEVPKLGKEAAVKAIKEWGQPKSKITHVVFCTTSGVDMPGADYQLTKLLGLRPSVKRLMMYQQGCFAGGTVLRLAKDLAENNRGARVLVVCSEITAVTFRGPSDTHLDSLVGQALFSDGAAALIVGSDADISAGEKPIFEMVSAAQTILPDSDGAIDGHLREVGLTFHLLKDVPGLISKNIEKSLDEAFKPLGISDWNSLFWIAHPGGPAILDDVEKKLGLKAEKMRATRHVLSEYGNMSSACVLFILDEMRRKSVEDGVATTGEGLEWGVLFGFGPGLTVETVVLHSVPV

SEQ ID NO: 812 - protein, 395 aa, Sinapis alba
MVMGTPSSLDEIRKAQRADGPAGILAIGTANPANHVIQAEYPDYYFRITNSEHMTDLKEKFKRMCDKSTIRKRHMHLTEEFLKDNPNMCAYMAPSLDARQDIVVVEVPKLGKEAAVKAIKEWGQPKSKITHVVFCTTSGVDMPGADYQLTKLLGLRPSVKRLMMYQQGCFAGGTVLRLAKDLAENNRGARVLVVCSEITAVTFRGPSDTHLDSLVGQALFSDGAAAIIVGSDPDTSVGEKPIFEMVSAAQTILPDSDGAIDGHLREVGLTFHLLKDVPGLISKNIEKSLDEAFKPLGISDWNSLFWIAHPGGPAILDDVEKKLGLKAEKMRATRHVLSEYGNMSSACVLFILDEMRRKSKEDGVATTGEGLEWGVLFGFGPGLTVETVVLHSVPV

SEQ ID NO: 813 - protein, 481 aa, Mus musculus
MEVASQALGPLVTELYDVQAFKFGSFVLKSGLSSPVYIDLRGIVSRPRLLSQVADILFQTAKNAGISFDSVCGVPYTALPLATVICSANHIPMLIRRKETKDYGTKRLVEGEINPGQTCLVIEDVVTSGASVLETVEVLQKEGLKVTDAIVLLDREQGGKDKLQAQGIRLHAVCTLSQMLEILQQQEKIDADMVGRVKRFIQENVFSAANHNGLPPPEKKACKELSFGARAELPGTHPLASKLLRLMQKKETNLCLSADVSEARELLQLADALGPSICMLKTHVDILNDFTLDVMEELTALAKRHEFLIFEDRKFADIGNTVKKQYESGTFKIASWADIVNAHVVPGSGVVKGLQEVGLPLHRACLLIAEMSSAGSLATGNYTKAAVGMAEEHCEFVIGFISGSRVSMKPEFLHLTPGVQLETGGDHLGQQYNSPQEVIGKRGSDVIIVGRGILAAANRLEAAEMYRKAAWEAYLSRLAVQ

SEQ ID NO: 814 - protein, 332 aa, Oryctolagus cuniculus
MAALKDQLIHNLLKEEHVPQNKITVVGVGAVGMACAISILMKDLADELALVDVMEDKLKGEMMDLQHGSLFLRTPKIVSGKDYSVTANSKLVIITAGARQQEGESRLNLVQRNVNIFKFIIPNVVKYSPHCKLLVVSNPVDILTYVAWKISGFPKNRVIGSGCNLDSARFRYLMGERLGVHALSCHGWILGEHGDSSVPVWSGMNVAGVSLKTLHPELGTDADKEQWKQVHKQVVDSAYEVIKLKGYTTWAIGLSVADLAESIMKNLRRVHPISTMLKGLYGIKEDVFLSVPCVLGQNGISDVVKVTLTSEEEAHLKKSADTLWGIQKELQF

SEQ ID NO: 815 - protein, 316 aa, Ralstonia metallidurans
MGAGHSHDHPGGNERSLKIALALTGTFLIAEVVGGVMTKSLALISDAAHMLTDTVALAIALAAIAIAKRPADKKRTFGYYRFEILAAAFNALLLFGVAIYILYEAYLRLKSPPQIESTGMFVVAVLGLIINLISMRMLSSGQSSSLNVKGAYLEVWSDLLGSVGVIAGAIIIRFTGWAWVDSAIAVLIGLWVLPRTWILLKSSLNVLLEGVPDDVDLAEVEKQILATPGVKSFHDLHIWALTSGKASLTVHVVNDTAVNPEMEVLPELKQMLADKFDITHVTIQFELAPCEQADAAQHFNASPALVGSKSLAAGGN

SEQ ID NO: 816 - protein, 588 aa, Xenopus laevis
MKEKAAETMEIPEGIPKDLEPKHPTLWRIIYYSFGVVLLATITAAYVAEFQVLKHEAILFSLGLYGLAMLLHLMMQSLFAFLEIRRVNKSELPCSFKKTVALTIAGYQENPEYLIKCLESCKYVKYPKDKLKIILVIDGNTEDDAYMMEMFKDVFHGEDVGTYVWKGNYHTVKKPEETNKGSCPEVSKPLNEDEGINMVEELVRNKRCVCIMQQWGGKREVMYTAFQAIGTSVDYVQVCDSDTKLDELATVEMVKVLESNDMYGAVGGDVRILNPYDSFISFMSSLRYWMAFNVERACQSYFDCVSCISGPLGMYRNNILQVFLEAWYRQKFLGTYCTLGDDRHLTNRVLSMGYRTKYTHKSRAFSETPSLYLRWLNQQTRWTKSYFREWLYNAQWWHKHHIWMTYESVVSFIFPFFITATVIRLIYAGTIWNVVWLLLCIQIMSLFKSIYACWLRGNFIMLLMSLYSMLYMTGLLPSKYFALLTLNKTGWGTSGRKKIVGNYMPILPLSIWAAVLCGGVGYSIYMDCQNDWSTPEKQKEMYHLLYGCVGYVMYWVIMAVMYWVWVKRCCRKRSQTVTLVHDIPDMCV

SEQ ID NO: 817 - protein, 145 aa, Xenopus laevis
GVVLLATITAAYVAEFQVLKHEAILFSLGLYGLAMLLHLMMQSLFAFLEIRRVNKSELPCSFKKTVALTIAGYQENPEYLIKCLESCKYVKYPKDKLKIILVIDGNTEDDAYMMEMFKDVFHGEDVGTYVWKGNYHTVKKPEETN

SEQ ID NO: 818 - protein, 839 aa, Drosophila melanogaster
MPAKVNKKENLDDLKQELDIDFHKISPEELYQRFQTHPENGLSHAKAKENLERDGPNALTPPKQTPEWVKFCKNLFGGFAMLLWIGAILCFVAYSIQASTSEEPADDNLYLGIVLSAVVIVTGIFSYYQESKSSKIMESFKNMVPQFATVIREGEKLTLRAEDLVLGDVVEVKFGDRIPADIRIIEARNFKVDNSSLTGESEPQSRGAEFTHENPLETKNLAFFSTNAVEGTAKGVVISCGDHTVMGRIAGLASGLDTGETPIAKEIHHFIHLITGVAVFLGVTFFVIAFILGYHWLDAVIFLIGIIVANVPEGLLATVTVCLTLTAKRMASKNCLVKNLEAVETLGSTSTICSDKTGTLTQNRMTVAHMWFDNQIIEADTTEDQSGVQYDRTSPGFKALSRIATLCNRAEFKGGQDGVPILKKEVSGDASEAALLKCMELALGDVMNIRKRNKKIAEVPFNSTNKYQVSIHETEDTNDPRYLLVMKGAPERILERCSTIFINGKEKVLDEEMKEAFNNAYMELGGLGERVLGFCDFMLPSDKYPNGFKFNTDDINFPIDNLRFVGLMSMIDPPRAAVPDAVAKCRSAGIKVIMVTGDHPITAKAIAKSVGIISEGNETVEDIAQRLNIPVSEVNPREAKAAVVHGAELRDVSSDQLDEILRYHTEIVFARTSPQQKLIIVEGCQRMGAIVAVTGDGVNDSPALKKADIGVAMGIAGSDVSKQAADMILLDDNFASIVTGVEEGRLIFDNLKKSIAYTLTSNIPEISPFLAFILCDIPLPLGTVTILCIDLGTDMVSLDLCPKPKLHRRLKLKLLLSQYHSSKLYSYTSCSPSQLIVKN

SEQ ID NO: 819 - protein, 363 aa, Drosophila melanogaster
MADKVNVCIVGSGNWGSAIAKIVGANAAALPEFEERVTMFVYEELIDGKKLTEIINETHENVKYLKGHKLPPNVVAVPDLVEAAKNADILIFVVPHQFIPNFCKQLLGKIKPNAIAISLIKGFDKAEGGGIDLISHIITRHLKIPCAVLMGANLANEVAEGNFCETTIGCTDKKYGKVLRDLFQANHFRVVVVDDADAVEVCGALKNIVACGAGFVDGLKLGDNTKAAVIRLGLMEMIRFVDVFYPGSKLSTFFESCGVADLITTCYGGRNRRVSEAFVTSGKTIEELEKEMLNGQKLQGPPTAEEVNYMLKNKGLEDKFPLFTAIHKICTNQLKPNDLIDCIRNHPEHMDTSIMPSPKLQNL

SEQ ID NO: 820 - protein, 333 aa, Anas platyrhynchos
MATLKEKLMTPVAAASAVPSSKITVVGVGQVGMACAVSILGKGLCDELALVDVLEDKLKGEMMDLQHGSLFLQTHKIVADKDYAVTANSKIVVVTAGVRQQEGESRLNLVQRNVGVFKGIIPQIVKYSPNCTILVVSNPVDILTYVTWKLSGLPKHRVIGSGCNLDTARFRYLMAERLGIHPTSCHGWILGEHGDSSVAVWSGVNVAGVSLQELNPAMGTDKDSENWKEVHKQVVESAYEVIRLKGYTNWAIGLSVAELCETMLKNLCRVHSVSTLVKGTYGIENDVFLSLPCVLSASGLTSVINQKLKDDEVAQLKKSADTLWSIQKDLKDM

SEQ ID NO: 821 - protein, 333 aa, Rattus norvegicus
MFRAAAPGQLRRAASLLRFQSTLVIAEHANDSLAPITLNTITAAGRLGGEVSCLVAGTKCDKVVQDLCKVAGVAKVLVAQHDAYKGLLPEELTPLILETQKQFSYTHICAGASAFGKNLLPRVAAKLNVAPVSDIIEIKSPDTFVRTIYAGNALCTVKCDEKVKVFSVRGTSFEAAAASGGSASSEKAPSSSSAGISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 822 - protein, 605 aa, Glycine max
MMRARFPLLLLGLVFLASVSVSFGIAYWEKENPKHNKCLQSCNSERDSYRNQACHARCNLLKVEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERNEEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFY

SEQ ID NO: 823 - protein, 154 aa, Glycine max
VEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERNEEEDEDEEQQRESEESEDSELRRHKNKNPFLFGSNRFETLFKNQYGRIRV

SEQ ID NO: 824 - protein, 428 aa, Spisula solidissima
MTTRAASANLANARMMHNMEEAGHMANLKGRPHTSHASQRNTLGDIGNQVSAITISDVPRKDPIIKKEIVHLSSHQHKILTKSKATTSLKSLAEESHIPKKQEAFTFLEPVAAMPKPTTVPTATVLPQPTVPVPMDISENVPESFSRVLLNVQNIDANDKENPQLVSEYVNDIYDYMRDLEGKYPIRHNYLENQEITGKMRAILIDWLCQVHHRFHLLQETLYLTVAIIDRLLQESPVPRNKLQLVGVTSMLIASKYEEMYAPEVADFVYITDNAYTKKEILEMEQHILKKLNFSFGRPLCLHFLRRDSKAGQVDANKHTLAKYLMELTITEYDMVQYLPSKIAAAALCLSMKLLDSTHWTETLTHYSSYCEKDLVSTMQKLASLVIKAENSKLTAVHTKYSSSKFMKISKLAALKSPLVKELAAASV

SEQ ID NO: 825 - protein, 334 aa, Mus musculus
MSEPIRVLVTGAAGQIAYSLLYSIGNGSVFGKDQPIILVLLDITPMMGVLDGVLMELQDCALPLLQDVIATDKEEIAFKDLDVAVLVGSMPRREGMERKDLLKANVKIFKSQGTALEKYAKKSVKVIVVGNPANTNCLTASKSAPSIPKENFSCLTRLDHNRAKSQIALKLGVTADDVKNVIIWGNHSSTQYPDVNHAKVKLQGKEVGVYEALKDDSWLKGEFITTVQQRGAAVIKARKLSSAMSAAKAIADHIRDIWFGTPEGEFVSMGVISDGNSYGVPDDLLYSFPVVIKNKTWKFVEGLPINDFSREKMDLTAKELTEEKETAFEFLSSA

SEQ ID NO: 826 - protein, 478 aa, Pseudomonas fluorescens
MSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLSDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 827 - protein, 147 aa, Cairina moschata
MVHWTAEEKQLITGLWGKVNVADCGAEALARLLIVYPWTQRFFASFGNLSSPTAILGNPMVRAHGKKVLTSFGDAVKNLDNIKNTFAQLSELHCDKLHVDPENFRLLGDILIIVLAAHFTKDFTPDCQAAWQKLVRVVAHALARKYH

SEQ ID NO: 828 - protein, 467 aa, Rattus norvegicus
MASQNSFRIEYDTFGELKVPTDKYYGAQTVRSTMNFKIGGATERMPIPVIKAFGILKRAAAEVNQEYGLDPKIASAIMKAADEVAEGKLNDHFPLVVWQTGSGTQTNMNVNEVISNRAIEMLGGELGSKKPVHPNDHVNKSQSSNDTFPTAMHIAAALEVHQVLLPGLQKLHDALSAKSKEFAQVIKIGRTHTQDAVPLTLGQEFSGYVQQVQYAMERIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKKTAIELGYLTAEQFDEWVKPKDMLGPK

SEQ ID NO: 829 - protein, 256 aa, Bacillus cereus
MKNTLLKLGVCVSLLGITPFVSTISSVQAERTVEHKVIKNETGTISISQLNKNVWVHTELGYFSGEAVPSNGLVLNTSKGLVLVDSSWDDKLTKELIEMVEKKFKKRVTDVIITHAHADRIGGMKTLKERGIKAHSTALTAELAKKNGYEEPLGDLQSVTNLKFGNMKVETFYPGKGHTEDNIVVWLPQYQILAGGCLVKSASSKDLGNVADAYVNEWSTSIENVLKRYGNINLVVPGHGEVGDRGLLLHTLDLLK

SEQ ID NO: 830 - protein, 146 aa, Turdus merula
VQWTAEEKQLITGLWGKVNVAECGGEALARLLIVYPWTQRFFASFGNLSSPTAVLGNPKVQAHGKKVLTSFGEAVKNLDSIKGTFAQLSELHCDKLHVDPENFRLLGDILVVVLAAHFGKDFTPDCQAAWQKLVRVVAHALARKYH

SEQ ID NO: 831 - protein, 142 aa, Oncorhynchus mykiss
SLSAKDKANVKAIWGKILPKSDEIGEQALSRMLVVYPQTKAYFSHWASVAPGSAPVKKHGITIMNQIDDCVGHMDDLFGFLTKLSELHATKLRVDPTNFKILAHNLIVVIAAYFPAEFTPEIHLSVDKFLQQLALALAEKYR

SEQ ID NO: 832 - protein, 125 aa, Schizosaccharomyces pombe
VKVNYNHFTSISDAISAMQNLKYLSCTNCEMSYVSPNLGKLKHLVHLDLHANNIKIFPEEVWQVSSLKVVNLSSNILEKIKLPVATSKKLTRTISQLKIMRTLSGNPVSSLSSQEFVMPTVEELY

SEQ ID NO: 833 - protein, 103 aa, Schizosaccharomyces pombe
KHLVHLDLHANNIKIFPEEVWQVSSLKVVNLSSNILEKIKLPVATSKKLTRTISQLKIMRTLSGNPVSSLSSQEFVMPTVEELYLVDNRLGNDCFTALEYFKC

SEQ ID NO: 834 - protein, 329 aa, Saccharomyces cerevisiae
MVSSFSVPMPVKRIFDTFPLQTYAAQTDKDEAVALEIQRRSYTFTERGGGSSELTVEGTYKLGVYNVFLEANTGAALATDPWCLFVQLALCQKNGLVLPTHSQEQTPSHTCNHEMLVLSRLSNPDEALPILVEGYKKRIIRSTVAISEIMRSRILDDAEQLMYYTLLDTVLYDCWITQIIFCASDAQFMELYSCQKLSGSIVTPLDVENSLLQKLSAKSLKISLTKRNKFQFRHREIVKSMQGVYHNHHNSVNQEQVLNVLFENSKQVLLGLKDMLKSDGQPTYLHLKIASYILCITNVKEPIKLKTFVENECKELVQFAQDTLKNFVQ

SEQ ID NO: 835 - protein, 92 aa, Saccharomyces cerevisiae
KQVPSVEINFLCVHKQLRSKRLTPVLIKEITRRVNKCDIWHALYTAGIVLPAPVSTCRYTHRPLNWKKLYEVDFTGLPDGHTEEDMIAENAL

SEQ ID NO: 836 - protein, 50 aa, Saccharomyces cerevisiae
FLCVHKQLRSKRLTPVLIKEITRRVNKCDIWHALYTAGIVLPAPVSTCRY

SEQ ID NO: 837 - protein, 392 aa, Manduca sexta
MKIIMCIFGLAALAMAGETDLQKILRESNDQFTAQMFSEVVKANPGQNVVLSAFSVLPPLGQLALASVGESHDELLRALALPNDNVTKDVFADLNRGVRAVKGVDLKMASKIYVAKGLELNDDFAAVSRDVFGSEVQNVDFVKSVEAAGAINKWVEDQTNNRIKNLVDPDALDETTRSVLVNAIYFKGSWKDKFVKERTMDRDFHVSKDKTIKVPTMIGKKDVRYADVPELDAKMIEMSYEGDQASMIIILPNQVDGITALEQKLKDPKALSRAEERLYNTEVEIYLPKFKIETTTDLKEVLSNMNIKKLFTPGAARLENLLKTKESLYVDAAIQKAFIEVNEEGAEAAAANAFGIVPASLILYPEVHIDRPFYFELKIDGIPMFNGKVIEP

SEQ ID NO: 838 - protein, 111 aa, Oryctolagus cuniculus
KDITVWIFVAVLSTIICLIMVWAVALKGYSMVTCIFPPVPGPKIKGFDTHLLEKGKSEELLSAFGCQDFPPTADCEDLLVEFLEVDDSEDQQLMPAHSKEHSGPGMKPTDL

SEQ ID NO: 839 - protein, 35 aa, Oryctolagus cuniculus
LIMVWAVALKGYSMVTCIFPPVPGPKIKGFDTHLL

SEQ ID NO: 840 - protein, 544 aa, Petroselinum crispum
MGDCVAPKEDLIFRSKLPDIYIPKHLPLHTYCFENISKVGDKSCLINGATGETFTYSQVELLSRKVASGLNKLGIQQGDTIMLLLPNSPEYFFAFLGASYRGAISTMANPFFTSAEVIKQLKASQAKLIITQACYVDKVKDYAAEKNIQIICIDDAPQDCLHFSKLMEADESEMPEVVINSDDVVALPYSSGTTGLPKGVMLTHKGLVTSVAQQVDGDNPNLYMHSEDVMICILPLFHIYSLNAVLCCGLRAGVTILIMQKFDIVPFLELIQKYKVTIGPFVPPIVLAIAKSPVVDKYDLSSVRTVMSGAAPLGKELEDAVRAKFPNAKLGQGYGMTEAGPVLAMCLAFAKEPYEIKSGACGTVVRNAEMKIVDPETNASLPRNQRGEICIRGDQIMKGYLNDPESTRTTIDEEGWLHTGDIGFIDDDDELFIVDRLKEIIKYKGFQVAPAELEALLLTHPTISDAAVVPMIDEKAGEVPVAFVVRTNGFTTTEEEIKQFVSKQVVFYKRIFRVFFVDAIPKSPSGKILRKDLRARIASGDLPK

SEQ ID NO: 841 - protein, 544 aa, Petroselinum crispum
MGDCVAPKEDLIFRSKLPDIYIPKHLPLHTYCFENISKVGDKSCLINGATGETFTYSQVELLSRKVASGLNKLGIQQGDTIMLLLPNSPEYFFAFLGASYRGAISTMANPFFTSAEVIKQLKASLAKLIITQACYVDKVKDYAAEKNIQIICIDDAPQDCLHFSKLMEADESEMPEVVIDSDDVVALPYSSGTTGLPKGVMLTHKGLVTSVAQQVDGDNPNLYMHSEDVMICILPLFHIYSLNAVLCCGLRAGVTILIMQKFDIVPFLELIQKYKVTIGPFVPPIVLAIAKSPVVDKYDLSSVRTVMSGAAPLGKELEDAVRAKFPNAKLGQGYGMTEAGPVLAMCLAFAKEPYEIKSGACGTVVRNAEMKIVDPETNASLPRNQRGEICIRGDQIMKGYLNDPESTRTTIDEEGWLHTGDIGFIDDDDELFIVDRLKEIIKYKGFQVAPAELEALLLTHPTISDAAVVPMIDEKAGEVPVAFVVRTNGFTTTEEEIKQFVSKQVVFYKRIFRVFFVDAIPKSPSGKILRKDLRAKIASGDLPK

SEQ ID NO: 842 - protein, 146 aa, Medicago sativa
MGFTDKQEALVNSSWESFKQNPGNSVLFYTIILEKAPAAKGMFSFLKDSAGVQDSPKLQSHAEKVFGMVRDSAAQLRATGGVVLGDATLGAIHIQKGVVDPHFAVVKEALLKTIKEVSGDKWSEELNTAWEVAYDALATAIKKAMV

SEQ ID NO: 843 - protein, 433 aa, Drosophila melanogaster
MTIKAIKARQIYDSRGNPTVEVDLTTELGLFRAAVPSGASTGVHEALELRDNDKANYHGKSVLKAVGHVNDTLGPELIKANLDVVDQASIDNFMIKLDGTENKSKFGANAILGVSLAVAKAGAAKKGVPLYKHIADLAGNKEIILPVPAFNVINGGSHAGNKLAMQEFMILPTGATSFTEAMKMGSEVYHHLKNVIKAKFGLDATAVGDEGGFAPNIQSNKEALNLISDAIAKAGYTGKIEIGMDVAASEFYKDGQYDLDFKNEKSDKSQWLPADKLANLYQEFIKDFPIVSIEDPFDQDHWEAWSNLTGCTDIQIVGDDLTVTNPKRIATAVEKKACNCLLLKVNQIGTVTESIAAHLLAKKNGWGTMVSHRSGETEDSFIGDLVVGLSTGQIKTGAPCRSERLAKYNQILRIEEEIGAGVKFAGKSFRKPQ

SEQ ID NO: 844 - protein, 316 aa, Oryctolagus cuniculus
MATHLVLYNGAKMPILGLGTWKSPPGQVTEAVKTAIDLGYRHIDCAHVYQNENEVGVALQEKLKEQVVKREELFIVSKLWCTSHDKSLVKGACQKTLNDLKLDYLDLYLIHWPTGFKHGSEYFPLDAAGNVIPSDTDFLDTWEAMEGLVDEGLVKSIGVSNFNHLQIERILNKPGLKYKPAVNQIECHPYLTQEKLIQYCHSKGIVVTAYSPLGSPDRPWAKPEDPSLLEDPRIKAIADKHKKTTAQVLIRFPMQRNLVVIPKSVTPARIAENFQVFDFELSSEDMTTLLSYNRNWRVCALVSCASHKDYPFHAEF

SEQ ID NO: 845 - protein, 487 aa, Oryctolagus cuniculus
MDPVVVLVLGLCCLLLLSHWKQNSGRGKLPPGPTPFPIIGNILQIDAKDISKSLTKFSERYGPVFTVYLGMKPAVVLHGYQAVKEALVDLGEEFAGRGSFPMLDKVSKGLGIVFTNGKRWKEIRRFSLMTLRNFGMGKRSIEDRVQEEARCLVEELRKTNASPCDPTFILGCAPCNVICSIIFHNRFDYKDEEFLKLLEKFNENVRILSSPWLQVCNNFPALIDYLPGSHKTLLKNSDYVKNFIMEKVKEHQKFLDVNNPRDFIDCFLIKMEQENHLEFTLESLVTTVFDLFGAGTETTSTTLRYSLLLLLKHPEVADKVQEEIERVIGRHRSPCMQDRSRMPYTDAVIHEIQRFIDLVPNNLPHTVTRDIKFRNYFIPKGTDIMTSLTSVLHDEKAFPNPKVFDPGHFLDESGNFKKSDYFMPFSAGKRICVGEALARMELFLFLTSILQNFKLQSLVEPKDLDITAVLNGFVSVPPSFQLCFIPV

SEQ ID NO: 846 - protein, 283 aa, Ustilago maydis
MSSITLQSYASRAAKQPNPAAKALLECMERKQTNLCVSIDVTNKQDLLDVCEAVGRNVCLVKTHIDIVEDFDMDLVHQLTQLSEKHDFLIFEDRKFADIGNTVSLQYSAGVHKIASWSHITNAHLVPGPSVISGLAKVGQPLGRGLLLLAEMSSEGALTKGDYTQACVDEAHKDTTGFVCGFIAMSRVDERERANTHRDLLILTPGVGLDVKGDGLGQQYRTPDQVIRESGCDVIIVGRGIYGALTTEEGKADKKAAFAKVSEQGERYKTAGWDAYLKRIGQK

SEQ ID NO: 847 - protein, 203 aa, Proteus mirabilis [sequence omitted]

SEQ ID NO: 848 - protein, 485 aa, Escherichia coli
MSELSQLSPQPLWDIFAKICSIPHPSYHEEQLAEYIVGWAKEKGFHVERDQVGNILIRKPATAGMENRKPVVLQAHLDMVPQKNNDTVHDFTKDPIQPYIDGEWVKARGTTLGADNGIGMASALAVLADENVVHGPLEVLLTMTEEAGMDGAFGLQGNWLQADILINTDSEEEGEIYMGCAGGIDFTSNLHLDREAVPAGFETFKLTLKGLKGGHSGGEIHVGLGNANKLLVRFLAGHAEELDLRLIDFNGGTLRNAIPREAFATIAVAADKVDVLKSLVNTYQEILKNELAEKEKNLALLLDSVANDKAALIAKSRDTFIRLLNATPNGVIRNSDVAKGVVETSLNVGVVTMTDNNVEIHCLIRSLIDSGKDYVVSMLDSLGKLAGAKTEAKGAYPGWQPDANSPVMHLVRETYQRLFNKTPNIQIIHAGLECGLFKKPYPEMDMVSIGPTITGPHSPDEQVHIESVGHYWTLLTELLKEIPAK

SEQ ID NO: 849 - protein, 32 aa, Oryctolagus cuniculus
LFTVEMILKLIAFKPKHYFCDAWNTFDALIVV

SEQ ID NO: 850 - protein, 148 aa, Oryctolagus cuniculus
LFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGK

SEQ ID NO: 851 - protein, 66 aa, Schizosaccharomyces pombe
LQLKTAKEILSNCKHLDFDYVNGEWATVELVFPINTEKLLMVSLVEKACSETVIHEIPGITRCFSK

SEQ ID NO: 852 - protein, 73 aa, Schizosaccharomyces pombe
LQLKTAKEILSNCKHLDFDYVNGEWATVELVFPINTEKLLMVSLVEKACSETVIHEIPGITRCFSKPPDSALD

SEQ ID NO: 853 - protein, 434 aa, Rattus norvegicus
MAMQKIFAREILDSRGNPTVEVDLHTAKGRFRAAVPSGASTGIYEALELRDGDKSRYLGKGVLKAVEHINKTLGPALLEKKLSVVDQEKVDKFMIELDGTENKSKFGANAILGVSLAVCKAGAAEKGVPLYRHIADLAGNPDLVLPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHISGEKLGELYKSFIKNYPVVSIEDPFDQDDWATWTSFLSGVDIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAVFAGRKFRNPKAK

SEQ ID NO: 854 - protein, 113 aa, Rattus norvegicus
KAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGH

SEQ ID NO: 855 - protein, 120 aa, Rattus norvegicus; identical to SEQ ID NO: 783

SEQ ID NO: 856 - protein, 261 aa, Mus musculus
MWFLILFLALSLGGIDAAPPVQSRIVGGFNCEKNSQPWHVAVYRYNKYICGGVLLDRNWVLTAAHCHVSQYNVWLGKTKLFQREPSAQHRMVSKSFPHPDYNMSLLIIHNPEPEDDESNDLMLLRLSEPADITDAVKPIALPTEEPKLGSTCLVSGWGSITPTKFQTPDDLQCVSIKLLPNEVCVKNHNQKVTDVMLCAGEMGGGKDTCKGDSGGPLICDGVLHGITAWGPIPCGKPNTPGVYTKLIKFTNWIKDTMAKNP

SEQ ID NO: 857 - protein, 153 aa, Mus musculus
YTVACQHRSNSEIICCTTPSLKQLGLQLPLKTKAFFLLDGILSKHFDLTYVHNPVFEPFEKPVMISMGNENVVEIKGNNIDPEAVKGEVLKVGNQSCESLHWHSGAVLCTVPSDLLKLNSELNIEWKQAVSSTVLGKVIVQPDQNFAGLIIGA

SEQ ID NO: 858 - protein, 98 aa, Mus musculus
IICCTTPSLKQLGLQLPLKTKAFFLLDGILSKHFDLTYVHNPVFEPFEKPVMISMGNENVVEIKGNNIDPEAVKGEVLKVGNQSCESLHWHSGAVLCT

SEQ ID NO: 859 - protein, 741 aa, Azotobacter vinelandii
MSTPKIIYTLTDEAPALATYSLLPIIKAFTGSSGIAVETRDISLAGRLIATFPEYLTDTQKISDDLAELGKLATTPDANIIKLPNISASVPQLKAAIKELQQQGYKLPDYPEEPKTDTEKDVKARYDKIKGSAVNPVLREGNSDRRAPLSVKNYARKHPHKMGAWSADSKSHVAHMDNGDFYGSEKAALIGAPGSVKIELIAKDGSSTVLKAKTSVQAGEIIDSSVMSKNALRNFIAAEIEDAKKQGVLLSVHLKATMMKVSDPIMFGQIVSEFYKDALTKHAEVLKQIGFDVNNGIGDLYARIKTLPEAKQKEIEADIQAVYAQRPQLAMVNSDKGITNLHVPSDVIVDASMPAMIRDSGKMWGPDGKLHDTKAVIPDRCYAGVYQVVIEDCKQHGAFDPTTMGSVPNVGLMAQKAEEYGSHDKTFQIPADGVVRVTDESGKLLLEQSVEAGDIWRMCQAKDAPIQDWVKLAVNRARATNTPAVFWLDPARAHDAQVIAKVERYLKDYDTSGLDIRILSPVEATRFSLARIREGKDTISVTGNVLRDYLTDLFPIMELGTSAKMLSIVPLMSGGGLFETGAGGSAPKHVQQFLEEGYLRWDSLGEFLALAASLEHLGNAYKNPKALVLASTLDQATGKILDNNKSPARKVGEIDNRGSHFYLALYWAQALAAQTEDKELQAQFTGIAKALTDNETKIVGELAAAQGKPVDIAGYYHPNTDLTSKAIRPSATFNAALAPLA

SEQ ID NO: 860 - protein, 171 aa, Xenopus laevis
APKLVGHLSEDGNSIKVDILKQDDGGSPIRHYLVNYRALNALEWKPEMRVPSNSHHVMLKALEWNVDYEVIVVAENQQGKSKPALLSFRTTAKPTATTATASAGTGLGTGAIVGILIVIFVLLLVVVDVTCFFLNKCGLLMCIAVNFCGKAGPGAKGKDIEEGKAAFSKDE

SEQ ID NO: 861 - protein, 165 aa, Xenopus laevis
KLVGHLSEDGNSIKVDILKQDDGGSPIRHYLVNYRALNALEWKPEMRVPSNSHHVMLKALEWNVDYEVIVVAENQQGKSKPALLSFRTTAKPTATTATASAGTGLGTGAIVGILIVIFVLLLVVVDVTCFFLNKCGLLMCIAVNFCGKAGPGAKGKDIEEGKAAF

SEQ ID NO: 862 - protein, 171 aa, Xenopus laevis; identical to SEQ ID NO: 860

SEQ ID NO: 863 - protein, 165 aa, Xenopus laevis; identical to SEQ ID NO: 861

SEQ ID NO: 864 - protein, 383 aa, Anabaena cylindrica
MDDKLMLMIPGPTPVPEAALLALAKHPIGHRTSEFSNMMGEVTQNLKWLHQTESDVLMLNVSGTGAVEAGMINFLSPGDRILVGSNGKFGERWVEVGQAFGLNVEAITAEWGQPLDPDKFAQKLQADTNKEIKAVIITHSETSTGVINDLVAINSHVKEHGQALIIVDAVTSLGAYNVPVDALGLDVVASGSQKGYMIPPGLGFVSVSPKAWEAYKTAKLPKYYLDLGKYRKATAKNTTPFTPPVNLMVALHTTLGMMKKEGLESIFTRHERQKNATRAAMKALNLPLFAADECASPAITAVATPGMEADKIRSLMKKRFDIALAGGQDHLSNKIFRVGHLGFVSDRDILSCIASLEVVLLELGHENFNSGAGVAAAARVFSN

SEQ ID NO: 865 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 866 - protein, 60 aa, Saccharomyces cerevisiae
QVELCGYVEDTLPKIISSDPNITVHHMSNLKRKGGGTSVIFMVKKVLFQVLSIFKLLWEL

SEQ ID NO: 867 - protein, 55 aa, Saccharomyces cerevisiae
LCGYVEDTLPKIISSDPNITVHHMSNLKRKGGGTSVIFMVKKVLFQVLSIFKLLW

SEQ ID NO: 868 - protein, 417 aa, Sus scrofa
MSHGKMPLVLSLVLILCGLFNSISCEKQQTSPKTITPVSFKRIAALSQKMEANYKAFAQELFKTLLIEDPRKNMIFSPVSISISLATLSLGLRSATRTNAIDVLDVALKNLAVMLMAQAPTALLEIVHELVNRTAKHQDILIDRTEMNQMFLKEIDRYIKMDIQMIDFKDKEKTKKAINQFVADKIDKKAKNLITHLDPQTLLCLVNYIFFKGILERAFQTNLTKKEDFFVNEKTIVQVDMMRKTERMIYSRSEELLATMVKIPCKENASIILVLPDTGKFNFALKEMAAKRARLQKTNDFRLVHLVVPKIKDNLQDRFKHLLPKIGINDIFTTKAVTWNTTGTSTILEAVHHAVIEVKEDGLTKNAAKDKDFWKVPVDKKEVPVVVKFDRPFFLFVEDEITRRDLFVAKVFNPKTE

SEQ ID NO: 869 - protein, 324 aa, Lithobates catesbeiana
MTLTKETRVTLNDGNMMPILGLGTYAAPDVPKSLAEEAVKTAIDVGYRHIDCAFITGNEMHIGNGIRSKISDGTVKREDIFYTGKLWCTYFSPDMVRKGLERSLRDVGMDYLDLFLMHWPVSLKPSGASDPSDKDKPFIYDNVDLCATWEALEARKDAGLVRSLGVSNFNRRQLERILNKPGLKYKPVCNQVECHVYLNQNKLHSYCKSKDIVLVTYSVLGSHRDRNWVDLSLPVLLDDPILNKIAAKYNRTSAEVAMRFILQKGIVVLAKSFTPARIKQNLGVFEFELKPEDMKTLESLDRNLHYGPFREVKQHPEYPFHDEY

SEQ ID NO: 870 - protein, 68 aa, Enterobacteria phage T4
TVCNLSRQLGKTTVVAIFLAHFVCFNKDKAVGILAHKGSMSAEVLDRTKQAIELLPDFLQPGIVEWNK

SEQ ID NO: 871 - protein, 74 aa, Enterobacteria phage
TVCNLSRQLGKTTVVAIFLAHFVCFNKDKAVGILAHKGSMSAEVLDRTKQAIELLPDFLQPGIVEWNKGSIELD

SEQ ID NO: 872 - protein, 68 aa, Enterobacteria phage T4; identical to SEQ ID NO: 870

SEQ ID NO: 873 - protein, 74 aa, Enterobacteria phage T4; identical to SEQ ID NO: 871

SEQ ID NO: 874 - protein, 429 aa, Sorghum bicolor
MGLSTAYSPVGSHLAPAPLGHRRSAQLHRPRRALLATVRCSVDAAKQVQDGVATAEAPATRKDCFGVFCTTYDLKAEDKTKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNAPDIPAKNFHALTRLDENRAKCQLALKAGVFYDKVSNVTIWGNHSTTQVPDFLNAKIDGRPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAYCDVPEDTMLPGEV

SEQ ID NO: 875 - protein, 147 aa, Ovis aries
MKALIILGLLCLSVAVQGKVFERCELARTLKELGLDGYKGVSLANWLCLTKWESSYNTKATNYNPGSESTDYGIFQINSKWWCNDGKTPNAVDGCHVSCSELMENNIAKAVACAKHIVSEQGITAWVAWKSHCRDHDVSSYVEGCSL

SEQ ID NO: 876 - protein, 490 aa, Oryctolagus cuniculus
MDPVVVLVLCLSCLLLLSLWKQSHGGGKLPPGPTPLPILGNILQIDFKDISKSLQNLSKVYGNVFTVYMGMKPTVVMYGYEAVKEALVDLGEEFSGRNLSPINKKVNKGLGVIFSNGKRWKEIRRFSLMTLRNFGMGKRSIEDRVQEEARCLVEELRKTNGSPCDPTFILGAAPCNVICSVIFQNRFDYKDETFLNLMGKFNENFRILNSPWLQVCNIFPILMDYLPGTHKTVFENFDYVRNFVLEKTKEHQESLDINNPRDFIDCFLIKMKQEKHNQQSEFTIENLMATVTDVFAAGTETTSTTLRYGLLLLMKHPEVTAKVQEEIERVIGRHRSPCMQDRSRMPYTDATVHEIQRYINLVPNNVPHATTCNVKFRNYFIPKGTAVLTSLTSVLHDNQEFLKPDKFDPGHFLDASGNFKKSDYFMPFSTGKRVCMGEALARMELFLFLTAILQNFTLKPLVDPKDIDTTPLVSGARSCATLYQLSFIPA

SEQ ID NO: 877 - protein, 143 aa, Saccharomyces cerevisiae
METNFSFDSNLIVIIIITLFATRIIAKRFLSTPKMVSQETVAHVKDLIGQKEVFVAAKTYCPYCKATLSTLFQELNVPKSKALVLELDEMSNGSEIQDALEEISGQKTVPNVYINGKHIGGNSDLETLKKNGKLAEILKPVFQ

SEQ ID NO: 878 - protein, 945 aa, Mus musculus
MGQNCQRGQAVDVEPKIRPPLTEEKIDKYLYAMRLSDEILIDILTRFKKEMKNGLSRDYNPTASVKMLPTFVRSIPDGSEKGDFIALDLGGSSFRILRVQVNHEKSQNVSMESEVYDTPENIVHGSGSQLFDHVAECLGDFMEKRKIKDKKLPVGFTFSFPCRQSKIDEAVLITWTKRFKASGVEGADVVKLLNKAIKKRGDYDANIVAVVNDTVGTMMTCGYDDQQCEVGLIIGTGTNACYMEELRHIDLVEGDEGRMCINTEWGAFGDDGSLEDIRTEFDRELDRGSLNPGKQLFEKMVSGMYMGELVRLILVKMAKESLLFEGRITPELLTRGKFTTSDVAAIETGWELSPDRRWYQAYMRCTQDTHRDKEGVQNAKEILTRLGVEPSHDDCVSVQHVCTIVSFRSANLVAATLGAILNRLRDNKGTPRLRTTVGVDGSLYKMHPQYSRRFHKTLRRLVPDSDVRFLLSESGSGKGAAMVTAVAYRLAEQHRQIEETLSHFRLSKQALMEVKKKLRSEMEMGLRKETNSRATVKMLPSYVRSIPDGTEHGDFLALDLGGTNFRVLLVKIRSGKKRTVEMHNKIYSIPLEIMQGTGDELFDHIVSCISDFLDYMGIKGPRMPLGFTFSFPCKQTSLDCGILITWTKGFKATDCVGHDVATLLRDAVKRREEFDLDVVAVVNDTVGTMMTCAYEEPSCEIGLIVGTGSNACYMEEMKNVEMVEGNQGQMCINMEWGAFGDNGCLDDIRTDFDKVVDEYSLNSGKQRFEKMISGMYLGEIVRNILIDFTKKGFLFRGQISEPLKTRGIFETKFLSQIESDRLALLQVRAILQQLGLNSTCDDSILVKTVCGVVSKRAAQLCGAGMAAVVEKIRENRGLDHLNVTVGVDGTLYKLHPHFSRIMHQTVKELSPKCTVSFLLSEDGSGKGAALITAVGVRLRGDPTNA

SEQ ID NO: 879 - protein, 530 aa, Mus musculus
MPGKWISALLLLQISCCFRSVKCGKVLVWPMEFSHWMNIKIILDELVQRGHEVTVLRPSAYYVLDPKKSPGLKFETFPTSVSKDNLENFFIKFVDVWTYEMPRDTCLSYSPLLQNMIDEFSDYFLSLCKDVVSNKELMTKLQESKFDVLLSDPVASCGELIAELLQIPFLYSIRFSPGYQIEKSSGRFLLPPSYVPVILSGLGGQMTFIERIKNMICMLYFDFWFQMFNDKKWDSFYSEYLGRPTTLVETMGQAEMWLIRSNWDLEFPHPTLPNVDYVGGLHCKPAKPLPKDMEEFVQSSGDHGVVVFSLGSMVSNMTEEKANAIAWALAQIPQKVLWKFDGKTPATLGHNTRVYKWLPQNDLLGHPKTKAFVTHGGANGVYEAIYHGIPMIGIPLFGEQHDNIAHMVAKGAAVALNIRTMSKSDVLNALEEVIENPFYKKNAIWLSTIHHDQPMKPLDRAVFWIEFVMRHKRAKHLRPLGHNLTWYQYHSLDVIGFLLSCVATTIVLSVKCLLFIYRFFVKKENKMKNE

SEQ ID NO: 880 - protein, 424 aa, Rattus norvegicus
MAALAVLHGVVRRPLLRGLLQEVRCLGRSYASKPTLNDVVIVSATRTPIGSFLGSLASQPATKLGTIAIQGAIEKAGIPKEEVKEVYMGNVIQGGEGQAPTRQATLGAGLPIATPCTTVNKVCASGMKAIMMASQSLMCGHQDVMVAGGMESMSNVPYVMSRGATPYGGVKLEDLIVKDGLTDVYNKIHMGNCAENTAKKLSISREEQDKYAIGSYTRSKEAWDAGKFANEITPITISVKGKPDVVVKEDEEYKRVDFSKVPKLKTVFQKENGTVTAANASTLNDGAAAVVLMTAEAAQRLKVKPLARIAAFADAAVDPIDFPLAPAYAVPKVLKYAGLKKEDIAMWEVNEAFSVVVLANIKMLEIDPQKVNVHGGAVSLGHPIGMSGARIVVHLAHALKQGEFGLASICNGGGGASAVLIEKL

SEQ ID NO: 881 - protein, 394 aa, Matthiola incana
MVMGATSLDEIRKAQRADGPAGILGIGTANPANHVIQAEYPDYYFRITNSEHMTDLKEKFQRMCDKSMIRKRHMHLTEDFLKENPNMCAYMAPSLDARQDIVVVEVPKLGKEAAVRAIKEWGQPKSKITHLVFCTTSGVDMPGADYQLTKLLGLRPSVKRLMMYQQGCFAGGTVLRLAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIEKSLEEAFKPLGISDWNSLFWIAHPGGPAILDQVEIKLGLKAEKMRATRHVLSEYGNMSSACVLFILDEMRKKSAQDGVATTGEGLEWGVLFGFGPGLTVETVVLRSVPL

SEQ ID NO: 882 - protein, 264 aa, Drosophila melanogaster
MARRYDSRTTIFSPEGRLYQVEYAMEAISHAGTCLGILAEDGILLAAECRSTNKLLDSAIPSEKIYRLNDNMVCSVAGITSDANVLTSELRLIAQRYQFSYGEVIPCEQLVSHLCDIKQAYTQYGGKRPFGVSLLYMGWDNKYGYQLYQSDPSGNYGGWKATCIGNNFGAAISMLKQELADKENVKLTLADAKDLAIKVLSMTLDTTKLTPEKVEMATLQRVDNKTVYSVLEKPDVEKLIEKYTKVQAEAEAAKKEKQAKQPTK

SEQ ID NO: 883 - protein, 414 aa, Xenopus laevis
MPSSMSVRLFTASAAQRKKIQEGDCCVVLAGKTQGRFILIGAVARVSGYIPSYLDKDELCVVCGDKATGYHYRCITCEGCKGFFRRTIQKNLHPSYSCKYEGKCVIDKVTRNQCQECRFKKCKTVGMATDLVLDDSKRLAKRKLIEENREKRRKDEIQKSIVQRPEPTQEEWELIQVVTEAHVATNAQGSHWKQKRKFLPEDIGQAPIVNAPEGGKVDLEAFSQFTKIITPAITRVVDFAKKLPMFCELPCEDQIILLKGCCMEIMSLRAAVRYDPESETLTLNGEMAVTRGQLKNGGLGVVSDAIFDLGVSLSSFSLDDTEVALLQAVLLMSSDRPGLSSVERIEKCQEGFLLAFEHYINYRKHNIAHFWPKLLMKVTDLRMIGACHASRFLHMKVECPTELFPPLFLEVFED

SEQ ID NO: 884 - protein, 240 aa, Mus musculus
MCFIKQGWCLVLELLLLPLGTGFQGHSIPDINATTGSNVTLKIHKDPLGPYKRITWLHTKNQKILEYNYNSTKTIFESEFKGRVYLEENNGALHISNVRKEDKGTYYMRVLRETENELKITLEVFDPVPKPSIEINKTEASTDSCHLRLSCEVKDQHVDYTWYESSGPFPKKSPGYVLDLIVTPQNKSTFYTCQVSNPVSSKNDTVYFTLPCDLARSSGVCWTATWLVVTTLIIHRILLT

SEQ ID NO: 885 - protein, 319 aa, Bacillus subtilis
MHTVTQTSLYGKDLLTLKDLSEEDINALLAEAGELKQNKIQPIFHGKTLAMIFEKSSTRTRVSFEAGMAQLGGSALFLSQKDLQLGRGETVADTAKVLSGYVDAIMIRTFEHEKVEELAKEADIPVINGLTDKYHPCQALADLLTIKEIKGKLKGVKVAYIGDGNNVAHSLMIGCAKMGCDISIASPKGYEVLDEAAEAAKTYALQSGSSVTLTDDPIEAVKDADVIYSDVFTSMGQEAEEQERLAVFAPYQVNAALVSHAKPDYTFLHCLPAHREEEVTAEIIDGPNSAVFQQAENRLHVQKALLKAILYKGESSKNC

SEQ ID NO: 886 - protein, 410 aa, Mus musculus
MKTPGVLLLILGLLASSSFAIIRIPLRKFTSIRRTMTEVGGSVEDLILKGPITKYSMQSSPKTTEPVSELLKNYLDAQYYGDIGIGTPPQCFTVVFDTGSSNLWVPSIHCKILDIACWVHHKYNSDKSSTYVKNGTSFDIHYGSGSLSGYLSQDTVSVPCKSDQSKARGIKVEKQIFGEATKQPGIVFVAAKFDGILGMGYPHISVNNVLPVFDNLMQQKLVDKNIFSFYLNRDPEGQPGGELMLGGTDSKYYHGELSYLNVTRKAYWQVHMDQLEVGNELTLCKGGCEAIVDTGTSLLVGPVEEVKELQKAIGAVPLIQGEYMIPCEKVSSLPTVYLKLGGKNYELHPDKYILKVSQGGKTICLSGFMGMDIPPPSGPLWILGDVFIGSYYTVFDRDNNRVGFANAVVL

SEQ ID NO: 887 - protein, 126 aa, Mus musculus
TDSKYYHGELSYLNVTRKAYWQVHMDQLEVGNELTLCKGGCEAIVDTGTSLLVGPVEEVKELQKAIGAVPLIQGEYMIPCEKVSSLPTVYLKLGGKNYELHPDKYILKVSQGGKTICLSGFMGMDI

SEQ ID NO: 888 - protein, 120 aa, Mus musculus
HGELSYLNVTRKAYWQVHMDQLEVGNELTLCKGGCEAIVDTGTSLLVGPVEEVKELQKAIGAVPLIQGEYMIPCEKVSSLPTVYLKLGGKNYELHPDKYILKVSQGGKTICLSGFMGMDI

SEQ ID NO: 889 - protein, 147 aa, Tarsius syrichta
MVHLTAEEKSSVTSLWGKMNVDEAGGEALGRLLVVYPWTQRFFDNFGNLSSSSAIMGNPKVKAHGKKVLTSFGDAIKNMDNLKGAFAKLSELHCDKLHVDPENFRLLGNVLVIILVTHFGKDFTPEVQVAWQKLVSGVATALAHKYH

SEQ ID NO: 890 - protein, 165 aa, Protobothrops flavoviridis
LTPEQQRFPQRYIELAIVVDHGMYKKYNHDSDKIKVRVHQMVNHINEMYRPLNIAITLSLLQIWSNKDLITVKSASNVTLNLFGNWRETVLLKRRSHDCAHLLTDINFTGNIIGLAYKQGMCNPKLSVGLVQDYSSNVFVVAVIMTHELGHNLGMEHDEEKNGKK

SEQ ID NO: 891 - protein, 74 aa, Protobothrops flavoviridis
VDHGMYKKYNHDSDKIKVRVHQMVNHINEMYRPLNIAITLSLLQIWSNKDLITVKSASNVTLNLFGNWRETVLL

SEQ ID NO: 892 - protein, 116 aa, Rattus norvegicus
VASEFGLKISFVDCSKTKLLEAAITPQTKLVWIETPTNPTLKLADIKACAQIVHKHKDIILVVDNTFMSAYFQRPLALGADICMCSATKYMNGHSDVVMGLVSVTSDDLNERLRFL

SEQ ID NO: 893 - protein, 124 aa, Rattus norvegicus
VASEFGLKISFVDCSKTKLLEAAITPQTKLVWIETPTNPTLKLADIKACAQIVHKHKDIILVVDNTFMSAYFQRPLALGADICMCSATKYMNGHSDVVMGLVSVTSDDLNERLRFLQNSLGAVP

SEQ ID NO: 894 - protein, 34 aa, Mus musculus; identical to SEQ ID NO: 770

SEQ ID NO: 895 - protein, 45 aa, Mus musculus
LLTKNKARVVILMVWIVSGLTSFLPIQMHWYRATHKKAIDCYTEE

SEQ ID NO: 896 - protein, 113 aa, Mesocricetus auratus; identical to SEQ ID NO: 854

SEQ ID NO: 897 - protein, 120 aa, Mesocricetus auratus; identical to SEQ ID NO: 783

SEQ ID NO: 898 - protein, 477 aa, Azotobacter vinelandii
MSQKFDVIVIGAGPGGYVAAIKSAQLGLKTALIEKYKGKEGKTALGGTCLNVGCIPSKALLDSSYKFHEAHESFKLHGISTGEVAIDVPTMIARKDQIVRNLTGGVASLIKANGVTLFEGHGKLLAGKKVEVTAADGSSQVLDTENVILASGSKPVEIPPAPVDQDVIVDSTGALDFQNVPGKLGVIGAGVIGLELGSVWARLGAEVTVLEAMDKFLPAVDEQVAKEAQKILTKQGLKILLGARVTGTEVKNKQVTVKFVDAEGEKSQAFDKLIVAVGRRPVTTDLLAADSGVTLDERGFIYVDDYCATSVPGVYAIGDVVRGAMLAHKASEEGVVVAERIAGHKAQMNYDLIPAVIYTHPEIAGVGKTEQALKAEGVAINVGVFPFAASGRAMAANDTAGFVKVIADAKTDRVLGVHVIGPSAAELVQQGAIAMEFGTSAEDLGMMVFAHPALSEALHEAALAVSGHAIHVANRKK

SEQ ID NO: 899 - protein, 147 aa, Pongo pygmaeus
MVHFTAEEKAAVTSLWSKMNVEEAGGEALGRLLVVYPWTQRFFDSFGNLSSPSAILGNPKVKAHGKKVLTSFGDAIKNMDNLKTTFAKLSELHCDKLHVDPENFKLLGNVMVIILATHFGKEFTPEVQAAWQKLVSAVAIALAHKYH

SEQ ID NO: 900 - protein, 147 aa, Pongo pygmaeus
MGHFTEEDKATITSLWGKVNVEDAGGETLGRLLVVYPWTQRFFDSFGNLSSASAIMGNPKVKAHGKKVLTSLGDAIKNLDDLKGTFAQLSELHCDKLHVDPENFRLLGNVLVTVLAIHFGKEFTPEVQASWQKMVTGVASALSSRYH

SEQ ID NO: 901 - protein, 147 aa, Pongo pygmaeus
MGHFTEEDKATITSLWGKLNVEDAGGETLGRLLLVYPWTQRFFDSFGNLSSASAIMGNPKVKAHGKKVLTSLGDAVKNLDDLKGTFAQLSELHCDKLHVDPENFRLLGNVLVTVLAIHFGKEFTPEVQASWQKMVTGVASALSSRYH

SEQ ID NO: 902 - protein, 379 aa, Torpedo californica
MTGEEVKEPKEQQEITEVKEQEPEISYNAIVLNGVGGYDKVKVEVKKGVPTLKSDEILVRVQACGLNFSDLLVRQGAFGKHHSLGTECAGVVEAIGDLVIDRKVGDKIIMLNIDGGLWTELVVTTVNRTFLMPDGMSFQEAAAISVNYTAAYVMIYDFANLRPSQSILIHMAAGGVGIAATQLCKLVHDVTIFGTASPSKHETIKENGVTYPIDYTTLDYAEEVRKIAPKGVDIVLDPLGGADDSKGFGLLKPLGKLVLYGSANQVTAPKRSSLAAAKVWWHKFNIDALQLINSNKAVCGFHLGRTDPDHVAEVIRKLISLYKEGKIKPKVDSVWSFEQVGDAMRHMRNTRTLEKSSWSLKSRQLMPQLEIKSVSKRQG

SEQ ID NO: 903 - protein, 339 aa, Saccharomyces cerevisiae
MPLPPSTLNQKSNRVYSVARVYKNACEERPQEYWDYEQGVTIDWGKISNYEIINKIGRGKYSEVFSGRCIVNNQKCVIKVLKPVKMKKIYRELKILTNLTGGPNVVGLYDIVQDADSKIPALIFEEIKNVDFRTLYPTFKLPDIQYYFTQLLIALDYCHSMGIMHRDVKPQNVMIDPTERKLRLIDWGLAEFYHPGVDYNVRVASRYHKGPELLVNLNQYDYSLDLWSVGCMLAAIVFKKEPFFKGSSNPDQLVKIATVLGTKELLGYLGKYGLHLPSEYDNIMRDFTKKSWTHFITSETKLAVPEVVDLIDNLLRYDHQERLTAKEAMDHKFFKTKFE

SEQ ID NO: 904 - protein, 521 aa, Salmonella typhimurium
MLDTNMKTQLRAYLEKLTKPVELIATLDDSAKSAEIKELLAEIAELSDKVTFKEDNTLPVRKPSFLITNPGSQQGPRFAGSPLGHEFTSLVLALLWTGGHPSKEAQSLLEQIRDIDGDFEFETYYSLSCHNCPDVVQALNLMAVLNPRIKHTAIDGGTFQNEITERNVMGVPAVFVNGKEFGQGRMTLTEIVAKVDTGAEKRAAEALNKRDAYDVLIVGSGPAGAAAAVYSARKGIRTGLMGERFGGQVLDTVDIENYISVPKTEGQKLAGALKAHVSDYDVDVIDSQSASKLVPAATEGGLHQIETASGAVLKARSIIIATGAKWRNMNVPGEDQYRTKGVTYCPHCDGPLFKGKRVAVIGGGNSGVEAAIDLAGIVEHVTLLEFAPEMKADQVLQDKVRSLKNVDIILNAQTTEVKGDGSKVVGLEYRDRVSGDIHSVALAGIFVQIGLLPNTHWLEGALERNRMGEIIIDAKCETSVKGVFAAGDCTTVPYKQIIIATGEGAKASLSAFDYLIRTKIA

SEQ ID NO: 905 - protein, 477 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 906 - protein, 332 aa, Rattus norvegicus
MSTVKEQLIQNLAPDEKQSRCKITVVGVGNVGMACAISILLKGLADELALVDADENKLKGEALDLLHGSLFLSTPKIVFGKDYSVSANSKLVIITAGARMVSGESRLALLQRNVTSMKAIVPGVIQNSPDCKIMIVTNPVDILTYVVWKISGLPVSSVIGSGCNLDSARFRYLIGEKLGVNPSSCHGWVLGEHGDSSVPIWSGVNIAGVTLKSLNPAIGSDSDKEQWKTVHKQVVDGGYEVLNLKGYTSWAIALSVTDIAASILKNLKRVHAVTTLVKGLYGIKEEIFLSIPCVLGQSGITDLVKVNMNTEEEALFKKSCDILWNIQKDLQL

SEQ ID NO: 907 - protein, 375 aa, Coturnix japonica
STAGKVIKCKAAVLWEANKPFSLEEVEVAPPKAHEVRIKIVATGICRSDDHVVTGALAMPFPVILGHEAAGVVESVGEKVTLLKPGDAVIPLFVPQCGECRSCLSTKGNLCIKNDLSSSPTGLMADGTTRFTCKGKAIHHFIGTSTFTEYTVVHETAAAKIDSAAPLEKVCLIGCGFSTGYGAVLQTAKVEPGSTCAVFGLGGVGLSVVMGCKAAGASRIIAIDINKDKFAKAKELGATECVNPKDFKKPIHEVLTEMTGKGVDYSFEVIGRIETMTEALASCHYNYGVSVIVGVPPAAQKISFDPMLIFSGRTWKGSVFGGWKSKDAVPKLVADYMKKKFVLDPLITHTLPFTKINEGFDLLRTGKSIRTVLVL

SEQ ID NO: 908 - protein, 520 aa, Rattus norvegicus
MSNKCDVIVVGGGISGMAAAKLLHDCGLSVVVLEARDRVGGRTYTIRNKNVKYVDLGGSYVGPTQNRILRLAKELGLETYKVNEVERLIHFVKGKSYAFRGPFPPVWNPITYLDYNNLWRTMDEMGQEIPSDAPWKAPLAEEWDYMTMKELLDKICWTNSTKQIATLFVNLCVTAETHEVSALWFLWYVKQCGGTTRIISTTNGGQERKFIGGSGQVSERIKDILGDRVKLERPVIHIDQTGENVVVKTLNHEIYEAKYVISAIPPVLGMKIHHSPPLPILRNQLITRVPLGSVIKCMVYYKEPFWRKKDFCGTMVIEGEEAPIAYTLDDTKPDGSCAAIMGFILAHKARKLVRLTKEERLRKLCELYAKVLNSQEALQPVHYEEKNWCEEQYSGGCYTAYFPPGILTQYGRVLRQPVGKIFFAGTETASHWSGYMEGAVEAGERAAREILHAIGKIPEDEIWQPEPESVDVPARPITNTFLERHLPSVPGLLKLLGLTTILSATALGFLAHKKGLFVRF

SEQ ID NO: 909 - protein, 108 aa, Bos taurus
VLCGVLGLRKWQYDVWSNDVTLANVMEAAGLPGKVHITKTTLACLNGDYEVEPGHGHERNSFLKTHNIETFFIVPSHRRKIFPGLILSDIKPAKRMKFKTVCYLLVQL

SEQ ID NO: 910 - protein, 147 aa, Otolemur crassicaudatus
MVHFTAEEKAIIMSLWGKVNIEEAGGEALGRLLVVYPWTQRFFETFGNLSSASAIMGNPKVKAHGKKVLTSFGEAVKNMDNLKGAFAKLSELHCDKLHVDPENFKLLGNVMVIILATHFGKEFTPDVQAAWQKLVSGVATALAHKYH

SEQ ID NO: 911 - protein, 147 aa, Otolemur crassicaudatus
MVHFTAEEKAIITSLWGKVNVEEDGGEALGRLLVVYPWTQRFFDTFGNLSSASAIMGNPKVKAHGKKVLSSLGEAIKNMDDLKGTFSHLSELHCDRLHVDPENFRLLGNVLVIVLAKHFGKEFTPQIQAACQKMVAGVATALAHKYH

SEQ ID NO: 912 - protein, 141 aa, Psittacula krameri
VLSGTDKTNVKSIFSKIGGQADDYGAEALERMFVTYPQTKTYFPHFDVSPGSAQVKAHGKKVAGGLSEAANHIDDIATSLSKLSDLHAQKLRVDPVNFKLLGQCFLVVVAIHNPSALTPEAHASLDKFLCAVGLVLTAKYR

SEQ ID NO: 913 - protein, 141 aa, Trigonoceps occipitalis
VLSANDKTNVKTVFTKITGHAEDYGAETLERMFITYPPTKTYFPHFDLHHGSAQIKAHGKKVVGALIEAVNHIDDIAGALSKLSDLHAQKLRVDPVNFKLLGQCFLVVVAIHHPSVLTPEVHASLDKFLCAVGNVLSAKYR

SEQ ID NO: 914 - protein, 332 aa, Bos taurus
MATLKDQLIQNLLKEEHVPQNKITIVGVGAVGMACAISILMKDLADEVALVDVMEDKLKGEMMDLQHGSLFLRTPKIVSGKDYNVTANSRLVIITAGARQQEGESRLNLVQRNVNIFKFIIPNIVKYSPNCKLLVVSNPVDILTYVAWKISGFPKNRVIGSGCNLDSARFRYLMGERLGVHPLSCHGWILGEHGDSSVPVWSGVNVAGVSLKNLHPELGTDADKEQWKAVHKQVVDSAYEVIKLKGYTSWAIGLSVADLAESIMKNLRRVHPISTMIKGLYGIKEDVFLSVPCILGQNGISDVVKVTLTHEEEACLKKSADTLWGIQKELQF

SEQ ID NO: 915 - protein, 364 aa, Saccharomyces cerevisiae
MVQEIDLGLTCDMHVHVREGAMCELVTPKIRDGGVSIAYIMPNLQPPITTLDRVIEYKKTLQKLAPKTTFLMSFYLSKDLTPDLIHEAAQQHAIRGVKCYPAGVTTNSAAGVDPNDFSAFYPIFKAMQEENLVLNLHGEKPSVHDGDKEPIHVLNAEEAFLPALKKLHNDFPNLKIILEHCTSESAIKTIEDINKNVKKATDVKVAATLTAHHLFLTIDDWAGNPVNFCKPVAKLPNDKKALVKAAVSGKPYFFFGSDSAPHPVQNKANYEGVCAGVYSQSFAIPYIAQVFEEQNALENLKGFVSDFGISFYEVKDSEVASSDKAILFKKEQVIPQVISDGKDISIIPFKAGDKLSWSVRWEPR

SEQ ID NO: 916 - protein, 90 aa, Arachis hypogaea
KEAATKAIKEWGQPMSKITHLIFCTTSGVALPGVDYELIVLLGLDPSVKRYMMYHQGCFAGGTVLRLAKDLAENNKDARVLIVCSENTAV

SEQ ID NO: 917 - protein, 78 aa, Arachis hypogaea
KAIKEWGQPMSKITHLIFCTTSGVALPGVDYELIVLLGLDPSVKRYMMYHQGCFAGGTVLRLAKDLAENNKDARVLIV

SEQ ID NO: 918 - protein, 177 aa, Rattus norvegicus
MKALLLTFGLSLLAALQAQAFPTTEENQDVSGTWYLKAAAWDKEIPDKKFGSVSVTPMKIKTLEGGNLQVKFTVLIAGRCKEMSTVLEKTDEPAKYTAYSGKQVLYIIPSSVEDHYIFYYEGKIHRHHFQIAKLVGRDPEINQEALEDFQSVVRAGGLNPDNIFIPKQSETCPLGSN

SEQ ID NO: 919 - protein, 250 aa, Mus musculus
MVTGRSAQLCLALLFMSLDVILTATEKSVLTLDPPWIRIFTGEKVTLSCYGNNHLQMNSTTKWIHNGTVSEVNSSHLVIVSATVQDSGKYICQKQGLFKSKPVYLNVTQDWLLLQTSADMILVHGSFDIRCHGWKNWNVRKVIYYRNDHAFNYSYESPVSIREATLNDSGTYHCKGYLRQVEYESDKFRIAVVKAYKCKYYWLQLIFPLLVAILFAVDTGLLLSTEEQFKSVLEIQKTGKYKKVETELLT

SEQ ID NO: 920 - protein, 91 aa, Mus musculus
LALLFMSLDVILTATEKSVLTLDPPWIRIFTGEKVTLSCYGNNHLQMNSTTKWIHNGTVSEVNSSHLVIVSATVQDSGKYICQKQGLFKSK

SEQ ID NO: 921 - protein, 99 aa, Mus musculus
AQLCLALLFMSLDVILTATEKSVLTLDPPWIRIFTGEKVTLSCYGNNHLQMNSTTKWIHNGTVSEVNSSHLVIVSATVQDSGKYICQKQGLFKSKPVYL

SEQ ID NO: 922 - protein, 111 aa, Nostoc sp.
MSKGVITITDAEFESEVLKAEQPVLVYFWASWCGPCQLMSPLINLAANTYSDRLKVVKLEIDPNPTTVKKYKVEGVPALRLVKGEQILDSTEGVISKDKLLSFLDTHLNNN

SEQ ID NO: 923 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 924 - protein, 571 aa, Saccharomyces cerevisiae
MDSRTVGILGGGQLGRMIVEAANRLNIKTVILDAENSPAKQISNSNDHVNGSFSNPLDIEKLAEKCDVLTIEIEHVDVPTLKNLQVKHPKLKIYPSPETIRLIQDKYIQKEHLIKNGIAVTQSVPVEQASETSLLNVGRDLGFPFVLKSRTLAYDGRGNFVVKNKEMIPEALEVLKDRPLYAEKWAPFTKELAVMIVRSVNGLVFSYPIVETIHKDNICDLCYAPARVPDSVQLKAKLLAENAIKSFPGCGIFGVEMFYLETGELLINEIAPRPHNSGHYTIDACVTSQFEAHLRSILDLPMPKNFTSFSTITTNAIMLNVLGDKHTKDKELETCERALATPGSSVYLYGKESRPNRKVGHINIIASSMAECEQRLNYITGRTDIPIKISVAQKLDLEAMVKPLVGIIMGSDSDLPVMSAACAVLKDFGVPFEVTIVSAHRTPHRMSAYAISASKRGIKTIIAGAGGAAHLPGMVAAMTPLPVIGVPVKGSCLDGVDSLHSIVQMPRGVPVATVAINNSTNAALLAVRLLGAYDSSYTTKMEQFLLKQEEEVLVKAQKLETVGYEAYLENK

SEQ ID NO: 925 - protein, 316 aa, Mus musculus
MATFVELSTKAKMPLVGLGTWKSSPGQVKEAVKAAIDAGYRHIDCAYVYHNENEVGEAIQEKIKENAVKREDLFIVSKLWATFFEKSLVKKAFQNTLSDLKLDYLDLYLVHWPQGFQAGNALLPKDNKGKVLLSKSTFLDAWEAMEELVDQGLVKALGISNFNHFQIERLLNKPGLKHKPVTNQIESHPYLTQEKLIQYCQSKGIAVTAYSPLGSPDRPYAKPEDPVVMEIPKIKEIAAKHKKTVAQVLIRFHVQRNVVVIPKSVTPSRIQENLQVFDFQLSEEDMAAILSFNRNWRACDLLDARTEEDYPFHEEY

SEQ ID NO: 926 - protein, 616 aa, Solanum tuberosum
MDADYGIPRELSDLQKLRSHYHPELPPCLQGTTVRVELRDATTAADPAGEHTIKRFFPHTYGQPLAHFLRATAKVPDAQIITEHPAIRVGVLFCGRQSPGGHNVIWGLHDALKVHNPKNILLGFLGGSEGLFAQKTLEITDDVLATYKNQGGYDMLGRTKDQIRTTEQVNAAMAACKALKLDGLVIIGGVTSNTDAAHLAEKFAETKCLTKVVGVPVTLNGDLKNQFVEANVGFDTICKVNSQLISNVCTDALSAEKYYYFIRLMGRKASHVALDCTLQSHPNMVILGEEVAASKLTIFDITQQICDAVQARAEHDKNHGVILLPEGLIESIPEVYSLLQEIHGLLRQGVSADKISSQLSPWASALFEFLPHFIRKQLLLHPESDDSAQLSQIETEKLIAHLVETEMNKRLKEGTYKGKKFNAICHFFGYQARGSLPSKFDCDYAYVLGHVCYHILAAGLNGYMATITNLKNPANKWHCGASPISAMMTVKRYGRGPGKASIGVPALHPATVDLRGKSYELLSQNATKFLLDDVYRNPGPLQFDGPGADAKAGSLVVEDADYIGAIKKLQEYLDKVRTIVKPGCSQDVLKAALSAMASVTDILSVISSPSSVSTPF

SEQ ID NO: 927 - protein, 552 aa, Solanum tuberosum
  MOD_RES (1)..(1): Any amino acid
XQVSGHRRYAAVYSEVQNSRLDHPLPLPSVLGSPFKVVDGPPSSAAGHPEEIAKLFPSLYGQPHVSLVPDDSGDVAMNQILKIGVVLSGGQAPGGHNVISGIFDYLQTHCKGSTMYGFRGGPAGVMKGKYVVLTPEFIYPYRNQGGFDMICSGRDKIETPEQFKQAEETAKKLDLDGLVVIGGDDSNTNACLLAENFRSKNLKTRVIGCPKTIDGDLKSKEVPTSFGFDTACKIYAEMIGNVMIDARSTGKYYHFVRLMGRAASHITLECALQTHPNVTLIGEEVFAKKLTLKNVTDYIADVVCKRAESGYNYGVILIPEGLIDFIPEVQQLIAELNEILAHDVVDEAGVWKKKLTPQCLELFELLPLAIQEQLLLERDPHGNVQVAKIETEKMLIQMVETELDQRKQKGAYNAQFKGQFHFFGYEGRCGLPSNFDSTYCYALGYGAGSLLQSGKTGLISSVGNLAAPVEELTVGGTALTALMDVERRHGKFKPVIKKAMVELEGAPFKKFASKREEWALNNRYINPGPIQFVGPVANKVNHTLLLELGVDA

SEQ ID NO: 928 - protein, 441 aa, Pisum sativum
MALTQLNSTCSKPQLHSSSQLSFLSRTRTRTLPRHYHSTFAPLHRTQHARISCSVAPNQVQVPAAQTQDPKGKPDCYGVFCLTYDLKAEEETKSWKKLINIAVSGAAGMISNHLLFKLASGEVFGPDQPIALKLLGSERSIQALEGVAMELEDSLFPLLREVVISIDPYEVFQDAEWALLIGAKPRGPGVERAALLDINGQIFAEQGKALNAVASRNAKVIVVGNPCNTNALICLKNAPNIPAKNFHALTRLDENRAKCQLALKAGVFYDKVSNMTIWGNHSTTQVPDFLNARIDGLPVKEVIKDNKWLEEEFTEKVQKRGGVLIQKWGRSSAASTSVSIVDAIRSLITPTPEGDWFSSGVYTNGNPYGIAEDIVFSMPCRSKGDGDYELVNDVIFDDYLRQKLAKTEAELLAEKKCVAHLTGEGIAVCDLPGDTMLPGEM

SEQ ID NO: 929 - protein, 434 aa, Mus musculus
MAMQKIFAREILDSRGNPTVEVDLHTAKGRFRAAVPSGASTGIYEALELRDGDKARYLGKGVLKAVEHINKTLGPALLEKKLSVVDQEKVDKFMIELDGTENKSKFGANAILGVSLAVCKAGAAEKGVPLYRHIADLAGNPDLVLPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHISGEKLGELYKNFIQNYPVVSIEDPFDQDDWATWTSFLSGVDIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAVFAGRKFRNPKAK

SEQ ID NO: 930 - protein, 576 aa, Rattus norvegicus
MRPAAATAPKWLLLALSALLPLWPTAKSWELTIMHTNDVHSRLEQTSDDSTKCLNASLCVGGVARLFTKVQQIRKEEPNVLLLDAGDQYQGTIWFTVYKGLEVAHFMNLLGYDAMALGNHEFDNGVEGLIDPLLRNVKFPILSANIKARGPLAPQISGLYLPYKVLSVGGEVVGIVGYTSKETPFLSNPGTNLVFEDEVTALQPEVDKLKTLNVNKIIALGHSGFEMDKLIAQKVRGVDVVVGGHTNTFLYTGNPPSKEVPAGKYPFIVTSDDGRKVPVVQAYAFGKYLGYLKVEFDDKGNVVTSYGNPILLNSTIREDAAIKADINQWRIKLDNYSTQELGRTIVYLNGSAQECRFRECNMGNLICDAMINNNLRHPDEMFWNHVSMCIVNGGGIRSPIDERNNGTITWENLAAVLPFGGTFDLVQLKGSTLKKAFEHSVHRYGQSTGEFLQVGGIHVVYDISRKPWDRVVQLKVLCTKCRVPIYEPLEMDKVYKVVLPSYLVNGGDGFQMIKDELLKHDSGDQDISVVSEYISKMKVIYPAVEGRIKFSAASHYQGSFPLIILSFWAVILVLYQ

SEQ ID NO: 931 - protein, 230 aa, Rattus norvegicus
MQLTLTLSRASGMQLFLLVSSLLLWEKVASKPTAIVSTDDLYHCLVEQSHNTFIMAADVYREFDINFAKRSWMKDRILPLCHTASIHTPENLEEVHEMKTEDFLNSIINVSVSWKEPLKHLVVCSDCSSGASVSMGKKAVDMKDKNLIILEGLQTLYNRTQAKVEENFENFDYPAWSGLKDLDSSDEEHHLFAICNLCRCVKRDIHKIDTYLKVLRCRVVFKNECGVSTF

SEQ ID NO: 932 - protein, 429 aa, Ovis aries
MSHRRMQLALSLVFILCGLFNSIFCEKQQHSQQHANLVLLKKISAFSQKMEAHPKAFAQELFKALIAENPKKNIIFSPAAMTITLATLSLGIKSTMSTNHPEDLELELKLLDAHKCLHHLVHLGRELVKQKQLRHQDILFLNSKMMANQMLLHQIRKLQKMDIQMIDFSDTEKAKKAISHHVAEKTHTKIRDLITDLNPETILCLVNHIFFKGILKRAFQPNLTQKEDFFLNDKTKVQVDMMRKTEQMLYSRSEELFATMVKMPFKGNVSLILMLPDAGHFDNALKKLTAKRAKLQKISNFRLVHLTLPKFKITFDINFKHLLPKINLKHLLPKIDPKHTLTTTASSQHVTLKAPLPNLEALHQVEIELSEHALTTDTAIHTDNLLKVPANTKEVPVVVKFNRPFLLFVEDEITQTDLFVGQVLNPQVE

SEQ ID NO: 933 - protein, 550 aa, Dictyostelium discoideum
MNKIIILLIILLSFDIISAAKKFGRKGIRTLGDNEVLLSDGAIRGTVTDTHRVFYGIPFARPPIDELRYEDPQPPKPWSYVRDGTKQRDQCIQDCKLGKGSCSEVGTSEDCLYLDVFIPRTVNPGSKVPVMVFIPGGAFTQGTGSCPLYDGLKFANSSVIVVNVNYRLGVLGFLCTGLLSGNFGFLDQVMALDWVQENIEVFGGDKNQVTIYGESAGAFSVAAHLSSEKSEGKFHRAILSSTPYTVGLKSQTVARGFAGRFSSKIGCDLEDIDCHRSKSPEEILAIQKELGLAIGDKILDAFTIWSPVVDGINVNEQPLTMIKQGTTHDVPTIIGDNQDEAILFVYMTYKNVVIPSSYRTMVHVLFGIANGNKVLEHYPLPGFLKDSRPILSKLLTDYLFRCPGRYHVSKSAQANESPIYHYQYKQVLSGGHSFEACEGLVCHGTELPMVFNTYESALDLDLEEEEEEFAEQLNNYFVNFIKYSNPSHPNGLPTPKVWNPTTKTTNTSLVMKLGFEVKDLITNDPKCDLFDSLSYNGYTKDQNRMRKSKK

SEQ ID NO: 934 - protein, 142 aa, Columba livia
MVLSANDKSNVKAVFAKIGGQAGDLGGEALERLFITYPQTKTYFPHFDLSHGSAQIKGHGKKVAEALVEAANHIDDIAGALSKLSDLHAQKLRVDPVNFKLLGHCFLVVVAVHFPSLLTPEVHASLDKFVLAVGTVLTAKYR

SEQ ID NO: 935 - protein, 1003 aa, Gallus gallus
MADRVLVIGSGGREHALAWKLAQSPHVKQVFVAPGNAGTANSGKISNSAVSVSNHAALAQFCRDQEIRLVVVGPEVPLAAGIVDDLTAAGVRCFGPTARAAQLESSKSFTKSFLDRHGIPTARWKSFTDPKAACSFINSANFPALVVKASGLAAGKGVIVASNKEEACKAVNDIMQDKTFGTAGETVVVEELLEGEEVSCLCFTDGVTIAPMPPAQDHKRLKDGDEGPNTGGMGAYSPAPQISKDLLLKIRETVLQKTLDGMRKEGIPYLGVLYAGLMLTKDGPKVLEFNCRFGDPECQVILPLLKSDLYEVMQAVINKKLSSSMPIWYEDSAAVTVVMASEGYPGTYPKGLEITGLSKAKELGLEVFHAGTALKDGKVVTNGGRVLTVTAIKEDLMTALQEANKGVAAINFKGSIYRKDIGYRAIAFLSQSRGLTYKNSGVDIAAGNILVQKIKPLAAATSRSGCNAELGGFAGLFDLKAAGYKDPILVSGTDGVGTKLKIAQVCKKHDTIGQDLVAMCVNDILAQGAEPLFFLDYFACGKLDVEVAQGVIAGIAEACQKAGCALLGGETAEMPGMYPPGEYDLAGFAVGAVERGQMLPQLERIADGDVVIGVASSGVHSNGYSLVRRIVEKSSLDFSSQVGVSGDQTLGDLLLTPTKIYSKTLLPVLRSGHVKAYAHITGGGLLENIPRVLPDSFGVVLDALSWKIPEIFCWLHKEGNLSEEEMARTFNCGIGAVLVVQKELAQQVLKDVQKHEAAWLIGKVVPLQKGSAHVKVHNLLQALQANRSLSVHSHIQGKIQTNKVKVAVLISGTGTNLEALINSTKKPTSFAEIVLVVSNKAGVEGLRKAERAGIPTRVIDHKQYGSRTEFDSAVDRVLEEFSVELICLAGFMRILSGPFVKKWEGKILNIHPSLLPSFKGANAHKLVLEAGVRVTGCTVHFVAEEVDAGAIIFQEAVPVKIGDTVETLSERVKEAEHRAFPAALQLVASGAVQVGEAGKICWK

SEQ ID NO: 936 - protein, 433 aa, Gallus gallus
MADRVLVIGSGGREHALAWKLAQSPHVKQVFVAPGNAGTANSGKISNSAVSVSNHAALAQFCRDQEIRLVVVGPEVPLAAGIVDDLTAAGVRCFGPTARAAQLESSKSFTKSFLDRHGIPTARWKSFTDPKAACSFINSANFPALVVKASGLAAGKGVIVASNKEEACKAVNDIMQDKTFGTAGETVVVEELLEGEEVSCLCFTDGVTIAPMPPAQDHKRLKDGDEGPNTGGMGAYSPAPQISKDLLLKIRETVLQKTLDGMRKEGIPYLGVLYAGLMLTKDGPKVLEFNCRFGDPECQVILPLLKSDLYEVMQAVINKKLSSSMPIWYEDSAAVTVVMASEGYPGTYPKGLEITGLSKAKELGLEVFHAGTALKDGKVVTNGGRVLTVTAIKEDLMTALQEANKGVAAINFKGSIYRKDIGYRAIAFLSQSR

SEQ ID NO: 937 - protein, 373 aa, Rattus norvegicus
MPGWSCLVTGAGGFVGQRIIRMLVQEKELQEVRALDKVFRPETKEEFSKLQTKAKVTMLEGDILDAQYLRRACQGISVVIHTAAVIDVSHVLPRQTILDVNLKGTQNILEACVEASVPAFIYCSTVDVAGPNSYKKIILNGHEEEHHESTWSDAYPYSKRMAEKAVLAANGSILKNGGTLHTCALRPMYIYGERSPFLSVMILAALKNKGILNVTGKFSIANPVYVGNVAWAHILAARGLRDPKKSQNVQGQFYYISDDTPHQSYDDLNCTLSKEWGLRLDSSWSLPLPLLYWLAFLLETVSFLLRPFYNYRPPFNCHLVTLSNSKFTFSYKKAQRDLGYVPLVSWEEAKQKTSEWIGTLVEQHRETLDTKSQ

SEQ ID NO: 938 - protein, 812 aa, Xenopus laevis
MFSGMSLLLWGVLLGAALSVARPPSTLPDEVAPKTKTEVEPYSAQPGDRITLQCRLREDVQSINWVKNGVQLSETNRTRITGEEIQISNAGPEDNGVYACVTNGPSRTYTVLCSVNVSDALPSAEDDDEDDDNSSSEEKAAENSKPNRPLWSHPEKMEKKLHAVPAAKTVKFRCPANGTPTPTLRWLKNNRAFQQDQRIGGYKVRSQTWSLIMDSVVPSDKGNYTCIVENKYGAINHTYQLDVVERSPHRPILQAGLPANTSVTVGTTAEFSCKVYSDPQPHIQWLRHIEINGSRVASDGFPYVEILKTAGVNTSDKDMEVLHLRNVTFEDAGQYTCLAANSIGISHHSAWLTVLKVEDNKPALLASPLQLEIIIYCTGAAFVSAMVVTIIIFKMKHPSKKSDFNSQLAVHKLAKSIPVRRQVTVSGDSSSSMNSGVILVRRLSSSGTPMLSGLSEYELPEDPRWEVARDRLILGKPLGEGCFGQVVMAEAIGLDKEKPNKVTKVAVKMLKSDASEKDLSDLISEMEMMKMIGKHKNIINLLGACTQDGPLYVIVEYTSKGNLREYLRARRPPAMEYCYNPTCVPDQLLSFKDLVSCAYQVARGMDYLASKKCIHRDLAARNVLVTEDNIMKIADFGLARDIHHIDYYKKTTNGRLPVKWMAPEALFDRIYTHQSDVWSFGVLLWEIFTLGGSPYPGVPMEELFKLLKEGHRMDKPTNCTNELYMMMKDCWHAMPSQRPTFNQLVEDLDRILALSSNQEYLDLSMPVNQYSPCFPDTRSSTCSSGEDSMFSHDPLPDEPCLPKYSNGGLKKR

SEQ ID NO: 939 - protein, 116 aa, Xenopus laevis
DGFPYVEILKTAGVNTSDKDMEVLHLRNVTFEDAGQYTCLAANSIGISHHSAWLTVLKVEDNKPALLASPLQLEIIIYCTGAAFVSAMVVTIIIFKMKHPSKKSDFNSQLAVHKLA

SEQ ID NO: 940 - protein, 50 aa, Xenopus laevis
HHSAWLTVLKVEDNKPALLASPLQLEIIIYCTGAAFVSAMVVTIIIFKMK

SEQ ID NO: 941 - protein, 116 aa, Xenopus laevis; identical to SEQ ID NO: 939

SEQ ID NO: 942 - protein, 50 aa, Xenopus laevis; identical to SEQ ID NO: 940

SEQ ID NO: 943 - protein, 607 aa, Avena sativa
MAKNYGDVYHVEGWGEPYFAVNKDGHLCVRIYGRETLPGQEIDVLSVIEQATSADGTGKKLQFPMILRFPDVLRHRINSLHTAFANAIKYTQYGSVYQGVFPVKVNQHKDVVQDMVHFGYDHSYGLEAGSKPELLIAMSCLTKAKPGAYLVCNGYKDSAYVALALAARAMGLNVIIVLEMEEELDIVIEESSKLGVEPVIGVRAKLLTKIPGHFGSTAGKHGKFGLPAEKIYEVAKKLKALNKLHWLKLLHFHVGSMIPTTDIVFKAASEASDIYCALVKEYGVETMTTLDCGGGLGVDYDGTRSGSSDMSVAYGLEEYASSIVQAVRLKCDYHGVPHPVLCTESGRAMASYHSMIILEALSAIPEPKDDEDEATTEQLHGRIRDLSSKLQPTGLSMSSHAVHIKKHGIEMYKLGKKLSKSVTTDAHTIYNYHMNLSVFSLMPDYWGIQHLFPMMPVSRLDEKPTHKATLVDVTCDSDGKVDKFIRDTETMPLHPLDPKLGGYYVAVLLTGAYQEALSNKHNLFGGPSLVRVVGTGNGGAFNVEAALLGSTTEELIGTVSYDVKQDISSVIEERARENKVWEMVEKLVESGLHTMPYLADYKPPPMA

SEQ ID NO: 944 - protein, 152 aa, Avena sativa
LVCNGYKDSAYVALALAARAMGLNVIIVLEMEEELDIVIEESSKLGVEPVIGVRAKLLTKIPGHFGSTAGKHGKFGLPAEKIYEVAKKLKALNKLHWLKLLHFHVGSMIPTTDIVFKAASEASDIYCALVKEYGVETMTTLDCGGGLGVDYD

SEQ ID NO: 945 - protein, 131 aa, Avena sativa
MGLNVIIVLEMEEELDIVIEESSKLGVEPVIGVRAKLLTKIPGHFGSTAGKHGKFGLPAEKIYEVAKKLKALNKLHWLKLLHFHVGSMIPTTDIVFKAASEASDIYCALVKEYGVETMTTLDCGGGLGVDY

SEQ ID NO: 946 - protein, 97 aa, Cyprinus carpio
KILRVLRVLRPLRAINRAKGLKHVVQCMFVAIKTIGNIVLVTMLLDFMFACIGVQLFKGKLYYCTDPLQKTAEECQGTFLKHVPNSLHDIEVHQRMW

SEQ ID NO: 947 - protein, 91 aa, Cyprinus carpio
PLRAINRAKGLKHVVQCMFVAIKTIGNIVLVTMLLDFMFACIGVQLFKGKLYYCTDPLQKTAEECQGTFLKHVPNSLHDIEVHQRMWVNSD

SEQ ID NO: 948 - protein, 410 aa, Cavia porcellus
MPSAISRGLLLLAGLCYLVFGIMAEDIQVAQVPSQHMPSHKVPRSLAHFAHSMHRVLTQQSNTSNIFFSPVSIATALAMVSLGAKGDTHTQILRSLEFNLTEIAEADIHDGFQNLLHTLNRPHSEHQLTTGNGLFLDQNLKLKEKFSGDVKTLYHAEAFPTNFSNPKEAEKQINAYVEKGTQGKIVDLVKDLGADTVLALVNYIFFRGKWEKPFDVKHTTQEDFHVDANTTVKVPMMKQQGMHKAFHCSTIQSWVLLLDYEGNVTALFLLPDEGKMQHLEETLTPELVFKFLRKTETMPAYVSLPKLSISGTYDLKEVLRDLGITNVFSGAADLSGITEDMPLKISKGLHKALLTIDEEGTEAAAATVLEATRTARPPRLSFNKPFFFLIIDHSTDTPLFVGKVMDPTKK

SEQ ID NO: 949 - protein, 403 aa, Cavia porcellus
SAIPRGLLLLAGLCCLVFGIMAEDAQVAQGPSQQIPRSLAHFAHSMYRVLTQQSNTSNIFFSPVSIATALAMVSLGAKGDTHTQILWGLEFNLTEIAEADIHDGFQNLLHTLNRPHSEHELTTGNGLFLDQKLKLKEKFSEDVKTLYHAEAFPTNFSNPKEAEKQINAYVEKGTQGKIVDLVKDLSADTVLALVNYIFFRGKWEKPFDVKHTTQEDFLVDMNTTVNVPMMKRQGMYKAFHCSTIQSWVLLLDYEGNVTTLFLLPDKGKMQHLEETLTPELIFKFARKTERMFANVHLPKLSISGTYDLKEVLGHLGITNVFSGAADLSGITEDMPLKISKGLHKALLTIDEKGTEAAGATELEITPHSVPQDLFFNKPFLFLIIDHSTDTPLFVGKVMDPTKK

SEQ ID NO: 950 - protein, 405 aa, Cavia porcellus
MPSAIPRGLLLLAGLCCLVFGIMAEDAQVAQGPSQQIPRSLAHFAHSMYRVLTQQSNTSNIFFSPVSIATALAMVSVGAKGDTHTQILRGLEFNLTEIAEADIHNGFQNLLHTLNRPHSEHQLTTGNGLFLDQKLKLKEKFSEDVKTLYHAEAFPTNFSNPKEAEKQINAYVEKGTQGKIVDLVKDLSADTVLALVNYIFFRGKWEKPFDVKHTTQEDFHVDTSTTVKVPMMKREGKYKAFHCSTIQSWVLLLDYEGNVTALFLLPEEGKMQHLEETLTPELIFKFARKTERMFANVHLPKLSISGTYDLKEVLGHLGITNVFSDAADLSGVTEDIPLKISKGLHKALLTIDEKGTEAAGATMMEFMPMSLPEDLSFNKPFLFLIIDHSTDTPLFVGKVMDPTKK

SEQ ID NO: 951 - protein, 457 aa, Xenopus laevis
MDFVLTRLILLFLAATIIYSSEDESRLINDLFKSYNKVVRPVKAFKDKVVVTVGLQLIQLINVNEVNQIVTTNVRLKQQWEDVHLKWDPEDYGGIKKVRIPSSDIWRPDIVLYNNADGDFAIVQETKVLLDYTGKIIWLPPAIFKSYCEMIVTYFPFDLQNCSMKLGTWTYDGTLVVINPENDRPDLSNFMESGEWYMKDYRCWKHWVYYDCCPETPYLDITYHFLLQRLPLYFIVNVVIPCLLFSFLTGLVFYLPTDSGEKITLSVSVLLSLVVFLLVIVELIPSTSSAVPLIGKYMLFTMVFVIASIVITVIVINTHHRSPSTHIMPQWLKKIFIETIPRVMFFSTMKRPAQDQHKKKIFTEDIDISDISGKLGPTAVKYQSPILKNPDVKSAIEGAKYVAETMKSDQESTKASEEWKFVAMVLDHLLLAVFMIVCIIGTLAIFAGRLIELHMQG

SEQ ID NO: 952 - protein, 413 aa, Mus musculus
MTPSISWGLLLLAGLCCMVPSFLAEDVQETDTSQKDQSPASHEIATNLGDFAISLYRELVHQSNTSNIFFSPVSIATAFAMLSLGSKGDTHTQILEGLQFNLTQTSEADIHKSFQHLLQTLNRPDSELQLSTGNGLFVNNDLKLVEKFLEEAKNHYQAEVFSVNFAESEEAKKVINDFVEKGTQGKIVEAVKELDQDTVFALANYILFKGKWKKPFDPENTEEAEFHVDKSTTVKVPMMMLSGMLDVHHCSILSSWVLLMDYAGNASAVFLLPEDGKMQHLEQTLNKELISKILLNRRRRLVQIHIPRLSISGDYNLKTLMSPLGITRIFNNGADLSGITEENAPLKLSKAVHKAVLTIDETGTEAAAATVFEAVPMSMPPILRFDHPFLFIIFEEHTQSPIFVGKVVDPTHK

SEQ ID NO: 953 - protein, 1020 aa, Drosophila melanogaster
MEDGHSKTVEQSLNFFGTDPERGLTLDQIKANQKKYGPNELPTEEGKSIWQLVLEQFDDLLVKILLLAAIISFVLALFEEHEETFTAFVEPLVILLILIANAVVGVWQERNAESAIEALKEYEPEMGKVVRQDKSGIQKVRAKEIVPGDLVEVSVGDKIPADIRITHIYSTTLRIDQSILTGESVSVIKHTDAIPDPRAVNQDKKNILFSGTNVAAGKARGVVIGTGLSTAIGKIRTEMSETEEIKTPLQQKLDEFGEQLSKVISVICVAVWAINIGHFNDPAHGGSWIKGAIYYFKIAVALAVAAIPEGLPAVITTCLALGTRRMAKKNAIVRSLPSVETLGCTSVICSDKTGTLTTNQMSVSRMFIFDKVEGNDSSFLEFEMTGSTYEPIGEVFLNGQRIKAADYDTLQELSTICIMCNDSAIDYNEFKQAFEKVGEATETALIVLAEKLNSFSVNKSGLDRRSAAIACRGEIETKWKKEFTLEFSRDRKSMSSYCTPLKASRLGTGPKLFVKGAPEGVLERCTHARVGTTKVPLTSALKAKILALTGQYGTGRDTLRCLALAVADSPMKPDEMDLGDSTKFYQYEVNLTFVGVVGMLDPPRKEVFDSIVRCRAAGIRVIVITGDNKATAEAICRRIGVFAEDEDTTGKSYSGREFDDLSPTEQKAAVARSRLFSRVEPQHKSKIVEFLQSMNEISAMTGDGVNDAPALKKAEIGIAMGSGTAVAKSAAEMVLADDNFSSIVSAVEEGRAIYNNMKQFIRYLISSNIGEVVSIFLTAALGLPEALIPVQLLWVNLVTDGLPATALGFNPPDLDIMEKPPRKADEGLISGWLFFRYMAIGFYVGAATVGAAAWWFVFSDEGPKLSYWQLTHHLSCLGGGDEFKGVDCKIFSDPHAMTMALSVLVTIEMLNAMNSLSENQSLITMPPWCNLWLIGSMALSFTLHFVILYVDVLSTVFQVTPLSAEEWITVMKFSIPVVLLDETLKFVARKIADGESPIYKMHGIVLMWAVFFGLLYAMML

SEQ ID NO: 954 - protein, 176 aa, Saccharomyces cerevisiae
QAQTKKLMRLSEIKLHDLEWIAAKTSVLYPDSYKYPSKQINELWENVLLCQFHDVLPGSCIEMVYKYEAVPMLHNVVKECTSLIDKTVQFLQSQSKADLVEMRTLTWSKPEKVSEECSLNGSYTSSVTGYDDYIVLANGKLKVIICKKTGVITSITDETLGVEYLDTEHGRNKLGA

SEQ ID NO: 955 - protein, 163 aa, Saccharomyces cerevisiae
LMRLSEIKLHDLEWIAAKTSVLYPDSYKYPSKQINELWENVLLCQFHDVLPGSCIEMVYKYEAVPMLHNVVKECTSLIDKTVQFLQSQSKADLVEMRTLTWSKPEKVSEECSLNGSYTSSVTGYDDYIVLANGKLKVIICKKTGVITSITDETLGVEYLDTEH

SEQ ID NO: 956 - protein, 389 aa, Petunia hybrida
MVSVEEVRRAQRREGPATILAIGTATPLNCVDQTTYPDYFFRVTNSDHKTELKEKFKRMFERSMIKKSYLHLTEEILKENPSICEHKAPSFDARQDIVVVEVPKLGKEAAQNAIKEWGQPKSKITHLVFCTTTGVDMHGADYQLTKLLGLSPSVKRLMMYQLGCYGGGTVLRLAKDLAENNKGARALVVCSEITAITFHAPSDTDLDVLVGQALFGDGAASVIIGSDPNLEVEKPLFELVSAAQTLVPDCGHKIYGKTSDVGLTFHLHKDVPRLVSQNIEKSLVEVFQPLGIFDWNSIFWVGHAGGREILDQVELKLGLKPEKLNVTRHVMSEYGNMASACVLFVLDEMRKTSTKEGFGTNVEGLEWGVLCSFGPGLTIETIVLHSVSI

SEQ ID NO: 957 - protein, 393 aa, Petunia hybrida
MATVEEIRKAQRAEGPATVLAIGTANPSNCVDQSAYPDFLFRITTSDHKTELKEKFKHMCEGSMIKKRYLHLTEEILKNNPNICEHKAPSLNARQEIAVAEAPKLGKRAAQKAIEEWSQSKSKITHLVFCTTTSVELPGADYQLTKLLGLSPSVKRSMMYQQGCYGGGTALRLAKDLAENNKGARVLVVCVEITVMSFQAPSRNDTDELDVLVGQALFADGASAVIIGSDPILAIEKPLFELVFATQTLIPDSGHVICANLTEAGLIPHLLKDAPIVISQNIERRLVEVFKPLGISDWNSIFWVAHPGGPAILNQIELKLGLKPEKLRAARHVLSEYGNMSSACVLFVLDEMRKGTIEKGMGTTGEGLEWGLLFGFGPGLTIETVVLHSVSIN

SEQ ID NO: 958 - protein, 389 aa, Petunia hybrida
MVTVEEIRRAQRAEGPATIMAIGTATPSNCVDQSTYPDYYFRITNSEHKTELKEKFQRMCDKSMIKKRYMHLTEEILKENPNICEYMAPSLDARQDIVVVEVPKLGKEAAQKAIKEWGQPKSKITHLVFCTTSGVDMPGADYQLTKLLGLRSSVKRLMMYQQGCFAGGTVLRLAKDLAENNKGARVLVVCSEITAVTFRGPNDTHLDSLVGQALFGDGAAAIIIGSDPLPGVERPLFELVSASQTLLPDSEGAIDGHLREVGLTFHLLKDVPGLISKNIQKSLVEAFQPLGISDWNSIFWIAHPGGPAILDQVELKLGLKPEKLRATRHVLSEYGNMSSACVLFILDEMRKASSKEGLGTTGEGLEWGVLFGFGPGLTVETVVLHSVST

SEQ ID NO: 959 - protein, 147 aa, Cygnodraco mawsoni
MVKWSKTELTIINDIFSHLDYDDIGPKALSRCLIVYPWTQRHFSGFGNLYNAEAIIGNANVAAHGIKVLHGLDRGLKNMDNIVDAYAELSTLHSEKLHVDPDNFKLLSDCITIVLAAKLGKAFTAETQAAFQKFMAVVVSALGKQYH

SEQ ID NO: 960 - protein, 146 aa, Cygnodraco mawsoni
VEWTNFERATIKDIFSKLEYDVVGPATLARCLVVYPWTQRYFGKFGNLYNAAAIAENAMVSKHGTTIIHGLDQAVKNMDDIKNTYAELSVLHCDKLHVDPDNFQLLAECLTIVLAAQLGKEFTGEVQAAFQKFMAVVVSSLGKQYH

SEQ ID NO: 961 - protein, 776 aa, Candida albicans
MHNINNGYVPNREKTITKRKVRLVGGKAGNLVLENPVPTELRKVLTRTESPFGEFTNMTYTACTSQPDTFSAEGFTLRAAKYGRETEIVICITMYNEDEVAFARTMHGVMKNIAHLCSRHKSKIWGKDSWKKVQVIIVADGRNKVQQSVLELLTATGCYQENLARPYVNNSKVNAHLFEYTTQISIDENLKFKGDEKNLAPVQVLFCLKESNQKKINSHRWLFNAFCPVLDPNVIVLLDVGTKPDNHAIYNLWKAFDRDSNVAGAAGEIKAMKGKGWINLTNPLVASQNFEYKLSNILDKPLESLFGYISVLPGALSAYRYIALKNHDDGTGPLASYFKGEDLLCSHDKDKENTKANFFEANMYLAEDRILCWELVSKRNDNWVLKFVKSATGETDVPETIAEFLSQRRRWINGAFFAALYSLYHFRKIWTTDHSYARKFWLHVEEFIYQLVSLLFSFFSLSNFYLTFYFLTGSLVSYKSLGKKGGFWIFTLFNYLCIGVLTSLFIVSIGNRPHASKNIFKTLIILLTICALYALVVGFVFVINTIATFGTGGTSTYVLVSIVVSLLSTYGLYTLMSILYLDPWHMLTCSVQYFLMIPSYTCTLQIFAFCNTHDVSWGTKGDNNPKEDLSNQYIIEKNASGEFEAVIVDTNIDEDYLETLYNIRSKRSNKKVALGHSEKTPLDGDDYAKDVRTRVVLFWMIANLVFIMTMVQVYEPGDTGRNIYLAFILWAVAVLALVRAIGSLGYLIQTYARFFVESKSKWMKRGYTAPSHNPLN

SEQ ID NO: 962 - protein, 49 aa, Rattus norvegicus
LLIFMPAKHHPEQPYVTKVKTWRMHLFTFIQLGCIALLWVVKSTVASLA

SEQ ID NO: 963 - protein, 25 aa, Rattus norvegicus
KVKTWRMHLFTFIQLGCIALLWVVK

SEQ ID NO: 964 - protein, 53 aa, Schistocerca gregaria
EIIPSTSLALPLLGKYLLFTMVLVGLSVVITIMVLNVHYRKPSTHKMAPWVRK

SEQ ID NO: 965 - protein, 44 aa, Schistocerca gregaria
LGKYLLFTMVLVGLSVVITIMVLNVHYRKPSTHKMAPWVRKVFI

SEQ ID NO: 966 - protein, 389 aa, Solanum lycopersicum
MVTVEEYRKAQRAEGPATILAIGTSTPSNCVDQSTYPDYYFRITNSEHKTELKEKFKRMCDKSMIKKRYMHLTEEILKENPNMCAYMAPSLDARQDIVVVEVPKLGKRGTQKAIKEWGQPKSKITHLVFCTTSGVDMPACDYQLAKLLPVRPSVKRLMMYQQGCFAGGTVLRLAKDLAENNKGARVLVVCSEITAVTFRGPSESHLDSLVGQALFGDGAAAIIIGSDPIIGVERPLFELVSAAQTLVPDSEGAIDGHLREVGLTFHLLKDVPGLISKNIEKSLLEAFQPLGISDWNSLFWIAHPGGPAILDQVELKLGLKPEKLRATREVLSNYGNMSSACVLFILDEMRKASTKEGLGTTGEGLEWGVLFGFGPGLTVETVVLHSVAA

SEQ ID NO: 967 - protein, 389 aa, Solanum lycopersicum
MVTVEEVRRAQRAKGPATIMAIGTATPSNCVDQSTYPDYYFRITNSEHMTELKEKFKRMCDKSMINKRYMHLTEEILKENPNICEYMAPSLDARQDIVVVEVPKLGKEAAQKAIKEWGQPKSKITHVVFCTTSGVDMPGADYQLTKLLGLRPSVKRLMMYQQGCFAGGTVIRLAKDLAENNKGARVLVVCSEITAVTFRGPSDTHLDSMVGQALFGDRAAAMIIGSDPLPEVERPLFELVSAAQTLLPDSEGAIDGHLREVGLTFHLLKDVPGLISKNIEKSLIEAFQPLGISDWNSIFWIAHPGGPAILDQVELKLSLKPEKLRATRQVLSDYGNMSSACVLFILDEMRKASSKEGLSTTGEGLDWGVLFGFGPGLTVETVVLHSVST

SEQ ID NO: 968 - protein, 856 aa, Mus musculus
MSLSEEQVRSFLDGNPTFAHQYFGKKLSPENVAGACEDGWLADCGSLRELCQVEESAALFELVQDMQESVNMERVVFKILRRLCTILHADRCSLFMYRQRNGIAELATRLFSVQPDSLLEDCLVPPDSEIVFPLDIGIVGHVAQTKKMINVQDVAECPHFSSFADELTDYVTKNILSTPIMNGKDVVAVIMAVNKLDGPCFTSEDEDVFTKYLNFATLNLKIYHLSYLHNCETRRGQVLLWSANKVFEELTDIERQFHKAFYTVRAYLNCERYSVGLLDMTKEKEFFDVWPVLMGEAQPYSGPRTPDGREIVFYKVIDYILHGKEDIKVIPTPPADHWALASGLPTYVAESGFICNIMNASADEMFNFQEGPLDDSGWVIKNVLSMPIVNKKEEIVGVATFYNRKDGKPFDDQDEVLMESLTQFLGWSVLNTDTYDKMNKLENRKDIAQDMVLYHVRCDKDEIQEILPTRDRLGKEPADCEEDELGKILKEELPGPTKFDIYEFHFSDLECTELELVKCGIQMYYELGVVRKFQIPQEVLVRFLFSVSKAYRRITYHNWRHGFNVAQTMFTLLMTGKLKSYYTDLEAFAMVTAGLCHDIDHRGTNNLYQMKSQNPLAKLHGSSILERHHLEFGKFLLAEESLNIYQNLNRRQHEHVIHLMDIAIIATDLALYFKKRTMFQKIVDESKNYEDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEEKKKEEDRVAAKKVGTEVCNGGPAPKSSTCCIL

SEQ ID NO: 969 - protein, 953 aa, Rattus norvegicus
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFENLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLVELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDSNEAAAADVLEFVREAIQRFDNLRMLIVEKMLEVFHAIKSVKIYRGALWILGEYCSTKEDIQSVMTEVRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSQMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNVTDLNDYLQHILKSTNMKCLTPEKALSGYCGFMAANLYARSIFGEDALANVSIEKPVHQGPDAAVTGHIRIRAKSQGMALSLGDKINLSQKKTSL

SEQ ID NO: 970 - protein, 170 aa, Rattus norvegicus
KFKNSTYFPGKLRRVIGDFGVPISILIMVLVDTFIKNTYTQKLSVPDGLKVSNSSARGWVIHPLGLYNHFPKWMMFASVLPALLVFILIFLESQITTLIVSKPERKMIKGSGFHLDLLLVVGMGGVAALFGMPWLSATTVRSVTHANALTVMGKASGPGAAAQIQEVKEQ

SEQ ID NO: 971 - protein, 59 aa, Rattus norvegicus
MGITSLSGIQLFDRILLLFKPPKYHPDVPFVKRVKTWRMHLFTGIQIICLAVLWVVKST

SEQ ID NO: 972 - protein, 170 aa, Rattus norvegicus; identical to SEQ ID NO: 970

SEQ ID NO: 973 - protein, 59 aa, Rattus norvegicus; identical to SEQ ID NO: 971

SEQ ID NO: 974 - protein, 389 aa, Pueraria montana
MVSVAEIRQAQRAEGPATILAIGTANPPNCVDQSTYPDYYFRITNSEHMTELKEKFQRMCDKSMIKKRYMYLTEEILKENPNMCAYMAPSLDARQDMVVVEVPKLGKEAATKAIKEWGQPKSKITHLIFCTTSGVDMPGADYQLTKQLGLRPYVKRYMMYQQGCFAGGTVLRLAKDLAENNKGARVLVVCSEITAVTFRGPSDTHLDSLVGQALFGDGAAAVIVGSDPIPQVEKPLYELVWTAQTIAPDSEGAIDGHLREVGLTFHLLKDVPGIVSKNIDKALFEAFNPLNISDYNSIFWIAHPGGPAILDQVEQKLGLKPEKMKATRDVLSDYGNMSSACVLFILDEMRRKSAENGLKTTGEGLEWGVLFGFGPGLTIETVVLRSVAI

SEQ ID NO: 975 - protein, 142 aa, Drosophila melanogaster
STGQDVALKKIRLEGETEGVPSTAIREISLLKNLKHPNVVQLFDVVISGNNLYMIFEYLNMDLKKLMDKKKDVFTPQLIKSYMHQILDAVGFCHTNRILHRDLKPQNLLVDTAGKIKLADFGLARAFNVPMRAYTHEVVTLW

SEQ ID NO: 976 - protein, 123 aa, Drosophila melanogaster
VVQLFDVVISGNNLYMIFEYLNMDLKKLMDKKKDVFTPQLIKSYMHQILDAVGFCHTNRILHRDLKPQNLLVDTAGKIKLADFGLARAFNVPMRAYTHEVVTLWYRAPEILLGTKFYSTGVDI

SEQ ID NO: 977 - protein, 142 aa, Latimeria chalumnae
GLTAADKTLIKSIWGKVEKETEAIGVEALVRLFKCFPQSKVYFDHFTDLSPSSQKLHAHAKVVLGALTKAVNHLDNITDTLHDISLVHAKKLLVDPVNFELLGHCLEVALAAHFATDFTPEVHLAIDKFLYEVEKALFETYR

SEQ ID NO: 978 - protein, 410 aa, Mycoplasma arginini
MSVFDSKFKGIHVYSEIGELESVLVHEPGREIDYITPARLDELLFSAILESHDARKEHKQFVAELKANDINVVELIDLVAETYDLASQEAKDKLIEEFLEDSEPVLSEEHKVVVRNFLKAKKTSRELVEIMMAGITKYDLGIEADHELIVDPMPNLYFTRDPFASVGNGVTIHYMRYKVRQRETLFSRFVFSNHPKLINTPWYYDPSLKLSIEGGDVFIYNNDTLVVGVSERTDLQTVTLLAKNIVANKECEFKRIVAINVPKWTNLMHLDTWLTMLDKDKFLYSPIANDVFKFWDYDLVNGGAEPQPVENGLPLEGLLQSIINKKPVLIPIAGEGASQMEIERETHFDGTNYLAIRPGVVIGYSRNEKTNAALEAAGIKVLPFHGNQLSLGMGNARCMSMPLSRKDVKW

SEQ ID NO: 979 - protein, 376 aa, Gallus gallus
MSTVGKVIKCKAAVLWEANKPFSLEEVEVAPPKAHEVRIKIVATGICRSDDHVVTGALAMPFPIILGHEAAGVIESVGEKVTSLKPGDAVIPLFVPQCGECRSCLSTKGNLCIKNDLSSSPTGLMADGTTRFTCKGKAIHHFVGTSTFTEYTVVHETAAAKIDSAAPLEKVCLIGCGFSTGYGAVLQTAKVEAGSTCAVFGLGGVGLSVVMGCKAAGASRIIAVDINKDKFAKAKELGATECINPKDFKKPIHEVLTEMTGQGVDYSFEVIGRIETMTAALASCHNNYGVSVIVGVPPAAQKISFDPMLIFSGRTWKGSVFGGWKSKDAVPKLVADYMKKKFVLDPLITHTLPFTKINEGFDLLRTGKSIRSVLVL

SEQ ID NO: 980 - protein, 118 aa, Rattus norvegicus
TDSRYYHGELSYLNVTRKAYWQVHMDQLEVGSELTLCKGGCEAIVDTGTSLLVGPVDEVKELQKAIGAVPLIQGEYMIPCEKVSSLPIITFKLGGQNYELHPEKYILKVSQAGKTICL

SEQ ID NO: 981 - protein, 109 aa, Rattus norvegicus
HGELSYLNVTRKAYWQVHMDQLEVGSELTLCKGGCEAIVDTGTSLLVGPVDEVKELQKAIGAVPLIQGEYMIPCEKVSSLPIITFKLGGQNYELHPEKYILKVSQAGKT

SEQ ID NO: 982 - protein, 501 aa, Mus musculus
MSSPAQPAVPAPLADLKIQHTKIFINNEWHNSVSGKKFPVLNPATEEVICHVEEGDKADVDKAVKAARQAFQIGSPWRTMDASERGRLLNKLADLMERDRLLLATMEALNGGKVFANAYLSDLGGCIKALKYCAGWADKIHGQTIPSDGDIFTYTRREPIGVCGQIIPWNFPMLMFIWKIGPALSCGNTVVVKPAEQTPLTALHLASLIKEAGFPPGVVNIVPGYGPTAGAAISSHMDVDKVAFTGSTQVGKLIKEAAGKSNLKRVTLELGGKSPCIVFADADLDIAVEFAHHGVFYHQGQCCVAASRIFVEESVYDEFVKRSVERAKKYVLGNPLTPGINQGPQIDKEQHDKILDLIESGKKEGAKLECGGGRWGNKGFFVQPTVFSNVTDEMRIAKEEIFGPVQQIMKFKSVDDVIKRANNTTYGLAAGLFTKDLDKAITVSSALQAGVVWVNCYMMLSAQCPFGGFKMSGNGRELGEHGLYEYTELKTVAMKISQKNS

SEQ ID NO: 983 - protein, 315 aa, Moraxella sp.
MLLKRLGLAALFSLSMVGCTTAPNTLAVNTTQKIIQYERSKSDLEVKSLTLASGDKMVYAENDNVTGEPLLLIHGFGGNKDNFTRIADKLEGYHLIIPDLLGFGNSSKPMTADYRADAQATRLHELMQAKGLASNTHVGGNSMGGAISVAYAAKYPKEIKSLWLVDTAGFWSAGVPKSLEGATLENNPLLINSKEDFYKMYDFVMYKPPYIPKSVKAVFAQERINNKALDTKILEQIVTDNVEERAKIIAKYNIPTLVVWGDKDQVIKPETTELIKEIIPQAQVIMMNDVGHVPMVEAVKDTANDYKAFRDGLKK

SEQ ID NO: 984 - protein, 106 aa, Saccharomyces cerevisiae
TEQTIPIVKHQLVKVGRNDKECQLVLTNPSISSVHCVFWCVFFDEDSIPMFYVKDCSLNGTYLNGLLLKRDKTYLLKHCDVIELSQGSEENDIKKTRLVFMINDDL

SEQ ID NO: 985 - protein, 124 aa, Saccharomyces cerevisiae
LATKDDIEMAGGVAPAHLEVNVGGYNTEQTIPIVKHQLVKVGRNDKECQLVLTNPSISSVHCVFWCVFFDEDSIPMFYVKDCSLNGTYLNGLLLKRDKTYLLKHCDVIELSQGSEENDIKKTRL

SEQ ID NO: 986 - protein, 178 aa, Mus musculus
VVYRAKDKKTDEIVALKRLKMEKEKEGFPITSLREINTILKAQHPNIVTVREIVVGSNMDKIYIVMNYVEHDLKSLMETMKQPFLPGEVKTLMIQLLSGVKHLHDNWILHRDLKTSNLLLSHAGILKVGDFGLAREYGSPLKAYTPVVVTLWYRAPELLLGAKEYSTAVDMWSVGCIF

SEQ ID NO: 987 - protein, 170 aa, Mus musculus
KAQHPNIVTVREIVVGSNMDKIYIVMNYVEHDLKSLMETMKQPFLPGEVKTLMIQLLSGVKHLHDNWILHRDLKTSNLLLSHAGILKVGDFGLAREYGSPLKAYTPVVVTLWYRAPELLLGAKEYSTAVDMWSVGCIFGELLTQKPLFPGKSDIDQINKIFKDLGTPSEK

SEQ ID NO: 988 - protein, 170 aa, Mus musculus; identical to SEQ ID NO: 987

SEQ ID NO: 989 - protein, 178 aa, Mus musculus; identical to SEQ ID NO: 986

SEQ ID NO: 990 - protein, 408 aa, Patella vulgata
MTTVTRSSSANLGASQKLAVKKGDAMMSSKGISNRSNRSALGDIGNKVSNMTIDPTKKALGLPVIKKEIIQKSKFTRSKTTVSESDILLQEKESACCSRAYTIFKDAIEPIVSTVDLMDISEDKPDAFSKVLLTVEDIDANDKDNPQLVSDYVNDIYHYMRHLEETFAVKANFLEGQEVTGKMRSILIDWLCQVHHRFHLLQETLYLTVSIIDRFLQVHPISRNKLQLVGVTSMLLASKYEEMYAPEVADFVYITDNAYTKADIRTMEQTILKTLDFSFGKPLCLHFLRRNSKAGQVDATKHTLAKYLMELTIIEYDMVHCNPSIIAAAALCLSMKVLDDSQWSETLAHYSNYSEKEIYPVMQKLAQLVVKAETSKLTAVKIKYSSSRFMKISSIPELKSNAITDLVL

SEQ ID NO: 991 - protein, 117 aa, Drosophila melanogaster
LMLRCSNCALTGKSEFELSKLNECPLDPGGYFVVRGQEKVILIQEQLSWNKMLTEDFNGVVQCQVTSSTHEKKSRTLVLSKHGKYYLKHNSMTDDIPIVVIFKALGVVSDQEIQSLI

SEQ ID NO: 992 - protein, 113 aa, Drosophila melanogaster
CALTGKSEFELSKLNECPLDPGGYFVVRGQEKVILIQEQLSWNKMLTEDFNGVVQCQVTSSTHEKKSRTLVLSKHGKYYLKHNSMTDDIPIVVIFKALGVVSDQEIQSLIGID

SEQ ID NO: 993 - protein, 445 aa, Helicobacter pylori
MKIFGTDGVRGKAGVKLTPMFVMRLGIAAGLYFKKHSQTNKILIGKDTRKSGYMVENALVSALTSIGYNVIQIGPMPTPAIAFLTEDMRCDAGIMISASHNPFEDNGIKFFNSYGYKLKEEEEKAIEEIFHDEELLHSSYKVGESVGSAKRIDDVIGRYIAHLKHSFPKHLNLQSLRIVLDTANGAAYKVAPVVFSELGADVLVINDEPNGCNINDQCGALHPNQLSQEVKKYRADLGFAFDGDADRLVVVDNLGNIVHGDKLLGVLGVYQKSKNALSSQAVVATNMSNLALKEYLKSQDLELKHCAIGDKFVSECMQLNKANFGGEQSGHIIFSDYAKTGDGLVCALQVSALVLESKQVSSVALNPFELYPQSLVNLNVQKKPPLESLKGYSALLKELDKLEIRHLIRYSGTENKLRILLEAKDEKLLESKMQELKEFFEGHLC

SEQ ID NO: 994 - protein, 595 aa, Solanum lycopersicum
MEFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRFTSERKNALILYRVNVDKESDLEKMIEDMKSSNMTTLNLSHNELVVDHLKHLVGGSANISDEIFGEFIVPEKAETLKTFLDAFSPRWNITLCRYRNQGDINASLLMGFQVPQAEMDEFKNQADKLGYPYELDNYNEAFNLVVSE

SEQ ID NO: 995 - protein, 91 aa, Dictyostelium discoideum
KKIVSAVGYLHGLNIVHRDLKPENLLLKSKENHLEVAIADFGLSKIIGQTLVMQTACGTPSYVAPEVLNATGYDKEVDMWSIGVITYILLC

SEQ ID NO: 996 - protein, 104 aa, Dictyostelium discoideum
KGSYSEADAANLVKKIVSAVGYLHGLNIVHRDLKPENLLLKSKENHLEVAIADFGLSKIIGQTLVMQTACGTPSYVAPEVLNATGYDKEVDMWSIGVITYILLC

SEQ ID NO: 997 - protein, 71 aa, Saccharomyces cerevisiae
KFTKIENLAVPKLFFGKRAMKIGFIIIVTGVLLGVKTFNDPVEHRCMALVECCAFLWASEAIPLHITGLLV

SEQ ID NO: 998 - protein, 93 aa, Saccharomyces cerevisiae
TKIENLAVPKLFFGKRAMKIGFIIIVTGVLLGVKTFNDPVEHRCMALVECCAFLWASEAIPLHITGLLVPLLTVLFRVLKDDDGKVMGAAAAS

SEQ ID NO: 999 - protein, 191 aa, Drosophila melanogaster
DEDAKDLITKAKVEDDEYRTEEQTYYSIAHTIHEKVVEQASIMVNGTLKEYQIKGLEWLVSLYNNNLNGILADEMGLGKTIQTISLVTYLMDRKKVMGPYLIIVPLSTLPNWVLEFEKWAPAVGVVSYKGSPQGRRLLQNQMRATKFNVLLTTYEYVIKDKAVLAKIQWKYMIIDEGHRMKNHHCKLTQVL

SEQ ID NO: 1000 - protein, 162 aa, Drosophila melanogaster
HTIHEKVVEQASIMVNGTLKEYQIKGLEWLVSLYNNNLNGILADEMGLGKTIQTISLVTYLMDRKKVMGPYLIIVPLSTLPNWVLEFEKWAPAVGVVSYKGSPQGRRLLQNQMRATKFNVLLTTYEYVIKDKAVLAKIQWKYMIIDEGHRMKNHHCKLTQVL

SEQ ID NO: 1001 - protein, 191 aa, Drosophila melanogaster; identical to SEQ ID NO: 999

SEQ ID NO: 1002 - protein, 162 aa, Drosophila melanogaster; identical to SEQ ID NO: 1000

SEQ ID NO: 1003 - protein, 434 aa, Oryctolagus cuniculus
MAMQKIFAREILDSRGNPTVEVDLHTAKGRFRAAVPSGASTGIYEALELRDGDKSRYLGKGVLKAVEHINKTLGPALLEKKLSVVDQEKVDKFMIELDGTENKSKFGANAILGVSLAVCKAGAAEKGVPLYRHIADLAGNHDLVLPVPAFNVINGGSHAGNKLAMQEFMILPVGASSFREAMRIGAEVYHHLKGVIKAKYGKDATNVGDEGGFAPNILENNEALELLKTAIQAAGYPDKVVIGMDVAASEFHRNGKYDLDFKSPDDPARHITGQKLGELYKSFIKNYPVVSIEDPFDQDDWATWTSFLSGVDIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAVFAGRKFRNPKAK

SEQ ID NO: 1004 - protein, 964 aa, Saccharomyces cerevisiae [sequence omitted]

SEQ ID NO: 1005 - protein, 88 aa, Saccharomyces cerevisiae
IGSDAIFVADSVYHTQSVLKNCQLDPVTAKNFHEPTKYVTVSLQVLATLLKLCLLDLGYKVEIYDKGWKLIKSASPGNIEQVNELMNM

SEQ ID NO: 1006 - protein, 83 aa, Saccharomyces cerevisiae
VYHTQSVLKNCQLDPVTAKNFHEPTKYVTVSLQVLATLLKLCLLDLGYKVEIYDKGWKLIKSASPGNIEQVNELMNMNIDSSI

SEQ ID NO: 1007 - protein, 62 aa, Bos taurus
CDRFYPSDLWLVVFQFQHIVVGLLLPGIVILSCYCIIISKLSHSKGYQKRKALKTTVILILT

SEQ ID NO: 1008 - protein, 56 aa, Bos taurus
VVFQFQHIVVGLLLPGIVILSCYCIIISKLSHSKGYQKRKALKTTVILILTFFACW

SEQ ID NO: 1009 - protein, 239 aa, Bacillus subtilis
MKNNLPIIALDFASAEETLAFLAPFQQEPLFVKVGMELFYQEGPSIVKQLKERNCELFLDLKLHDIPTTVNKAMKRLASLGVDLVNVHAAGGKKMMQAALEGLEEGTPAGKKRPSLIAVTQLTSTSEQIMKDELLIEKSLIDTVVHYSKQAEESGLDGVVCSVHEAKAIYQAVSPSFLTVTPGIRMSEDAANDQVRVATPAIAREKGSSAIVVGRSITKAEDPVKAYKAVRLEWEGIKS

SEQ ID NO: 1010 - protein, 439 aa, Glycine max
MMRVRFPLLVLLGTVFLASVCVSLKVREDENNPFYFRSSNSFQTLFENQNVRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALY

SEQ ID NO: 1011 - protein, 20 aa, Glycine max
MMRVRFPLLVLLGTVFLASV

SEQ ID NO: 1012 - protein, 135 aa, Candida albicans
ADTTVVEFVIEDGEVGLTKDVVVDKLREFNFSDEMINMPIQSLSGGWKMKLALARAVLKNADILLLDEPTNHLDTVNVAWLVNYLNTCGITSIIVSHDSGFLDNVTQYIIHYEGFKLRKYKGNLSEFVKKCPSAQ

SEQ ID NO: 1013 - protein, 117 aa, Candida albicans
VGLTKDVVVDKLREFNFSDEMINMPIQSLSGGWKMKLALARAVLKNADILLLDEPTNHLDTVNVAWLVNYLNTCGITSIIVSHDSGFLDNVTQYIIHYEGFKLRKYKGNLSEFVKKC

SEQ ID NO: 1014 - protein, 563 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVIRLIELKLPVFDAPESLIKQAQLTAATNAKQ

SEQ ID NO: 1015 - protein, 377 aa, Escherichia coli
MSSLNIKQGSDAHFPDYPLASPSNNEIDLLNLISVLWRAKKTVMAVVFAFACAGLLISFILPQKWTSAAVVTPPEPVQWQELEKSFTKLRVLDLDIKIDRTEAFNLFIKKFQSVSLLEEYLRSSPYVMDQLKEAKIDELDLHRAIVALSEKMKAVDDNASKKKDEPSLYTSWTLSFTAPTSEEAQTVLSGYIDYISTLVVKESLENVRNKLEIKTQFEKEKLAQDRIKTKNQLDANIQRLNYSLDIANAAGIKKPVYSNGQAVKDDPDFSISLGADGIERKLEIEKAVTDVAELNGELRNRQYLVEQLTKAHVNDVNFTPFKYQLSPSLPVKKDGPGKAIIVILSALIGGMVACGGVLLRYAMASRKQDAMMADHLV

SEQ ID NO: 1016 - protein, 444 aa, Solanum lycopersicum
MATIKSIKARQIFDSRGNPTVEVDVHISNGVFARAAVPSGASTGIYEALELRDGGSDYLGKGVSKAVNNVNSIIGPALVGKDPTDQTGLDNFMVHQLDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKAVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTAEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 1017 - protein, 315 aa, Glycine max
MAAAIEIPTIVFPNSSAQQRMPVVGMGSAPDFTCKKDTKEAIIEAVKQGYRHFDTAAAYGSEQALGEALKEAIHLGLVSRQDLFVTSKLWVTENHPHLVLPALRKSLKTLQLEYLDLYLIHWPLSSQPGKFSFPIEVEDLLPFDVKGVWESMEECQKLGLTKAIGVSNFSVKKLQNLLSVATIRPVVDQVEMNLAWQQKKLREFCKENGIIVTAFSPLRKGASRGPNEVMENDVLKEIAEAHGKSIAQVSLRWLYEQGVTFVPKSYDKERMNQNLHIFDWALTEQDHHKISQISQSRLISGPTKPQLADLWDDQI

SEQ ID NO: 1018 - protein, 184 aa, Drosophila melanogaster
TCQALKQMKIKRLFPVQKQVIPWILEAHAKPPPFRPRDICVSAPTGSGKTLAFAIPIVQLLSQRVDCKVRALVVLPVAELALQVYRVISELCSKTELEVCLLSKQHKLEDEQEKLVEQYKGKYYSKADIVVTTPGRLVDHLHATKGFCLKSLKFLVIDEADRIMDAVFQNWLYHLDSHVKETTD

SEQ ID NO: 1019 - protein, 47 aa, Drosophila melanogaster
KADIVVTTPGRLVDHLHATKGFCLKSLKFLVIDEADRIMDAVFQNWL

SEQ ID NO: 1020 - protein, 233 aa, Pisum sativum
MAARTLLCRKTLSSVLRNDAKPIGAAIAAASTQSRGLHVFTLPDLAYDYGALEPVISGEIMQIHHQKHHQTYITNYNKALEQLHDAVAKADTSTTVKLQNAIKFNGGGHINHSIFWKNLAPVSEGGGEPPKESLGWAIDTNFGSLEALIQKINAEGAALQWLGLDKDLKRLVVETTQDPLVTKGASLVPLLGIDVWEHAYYLQYKNVRPDYLKNIWKVINWKHASEVYEKESS

SEQ ID NO: 1021 - protein, 270 aa, Arabidopsis thaliana
MGTEAYDEAIEALKKLLIEKEELKTVAAAKVEQITAALQTGTSSDKKAFDPVETIKQGFIKFKKEKYETNPALYGELAKGQSPKYMVFACSDSRVCPSHVLDFQPGDAFVVRNIANMVPPFDKVKYGGVGAAIEYAVLHLKVENIVVIGHSACGGIKGLMSFPLDGNNSTDFIEDWVKICLPAKSKVISELGDSAFEDQCGRCEREAVNVSLANLLTYPFVREGLVKGTLALKGGYYDFVKGAFELWGLEFGLSETSSVKDVATILHWKL

SEQ ID NO: 1022 - protein, 86 aa, Enterobacteria phage P21
ASVLITGPSGNDGLEGVSYIPYKDIVGVWTVCHGHTGKDIMLGKTYTKAECKALLNKDLATVARQINPYIKVDIPETMRGALYSLL

SEQ ID NO: 1023 - protein, 501 aa, Saccharomyces cerevisiae
MSHRIAPSKERSSSFISILDDETRDTLKANAVMDGEVDVKKTKGKSSRYIPPWTTPYIIGIGGASGSGKTSVAAKIVSSINVPWTVLISLDNFYNPLGPEDRARAFKNEYDFDEPNAINLDLAYKCILNLKEGKRTNIPVYSFVHHNRVPDKNIVIYGASVVVIEGIYALYDRRLLDLMDLKIYVDADLDVCLARRLSRDIVSRGRDLDGCIQQWEKFVKPNAVKFVKPTMKNADAIIPSMSDNATAVNLIINHIKSKLELKSNEHLRELIKLGSSPSQDVLNRNIIHELPPTNQVLSLHTMLLNKNLNCADFVFYFDRLATILLSWALDDIPVAHTNIITPGEHTMENVIACQFDQVTAVNIIRSGDCFMKSLRKTIPNITIGKLLIQSDSQTGEPQLHCEFLPPNIEKFGKVFLMEGQIISGAAMIMAIQVLLDHGIDLEKISVVVYLATEVGIRRILNAFDNKVNIFAGMIISREKLQNHQYKWALTRFFDSKYFGCD

SEQ ID NO: 1024 - protein, 377 aa, Mus musculus
MADFLPSRSVLSVCFPGCVLTNGEAEQQRKSKEIDKCLSREKTYVKRLVKILLLGAGESGKSTFLKQMRIIHGQDFDQRAREEFRPTIYSNVIKGMRVLVDAREKLHIPWGDNKNQLHGDKLMAFDTRAPMAAQGMVETRVFLQYLPAIRALWEDSGIQNAYDRRREFQLGESVKYFLDNLDKLGVPDYIPSQQDILLARRPTKGIHEYDFEIKNVPFKMVDVGGQRSERKRWFECFDSVTSILFLVSSSEFDQVLMEDRQTNRLTESLNIFETIVNNRVFSNVSIILFLNKTDLLEEKVQVVSIKDYFLEFEGDPHCLRDVQKFLVECFRGKRRDQQQRPLYHHFTTAINTENIRLVFRDVKDTILHDNLKQLMLQ

SEQ ID NO: 1025 - protein, 437 aa, Caenorhabditis elegans
MAQSKPAYKVADIKLADFGRKEIILAENEMPGLMAMRSKYGPSQPLKGARIAGCLHMTIQTAVLIETLTALGAEVQWSSCNIFSTQDHAAAAIAQTGVPVYAWKGETDEEYEWCIEQTIVFKDGQPLNMILDDGGDLTNLVHAKYPQYLAGIRGLSEETTTGVHNLAKMLAKGDLKVPAINVNDSVTKSKFDNLYGIRESLPDGIKRATDVMLAGKVAVVAGYGDVGKGSAASLKAFGSRVIVTEIDPINALQAAMEGYEVTTLEEAAPKANIIVTTTGCKDIVTGKHFELLPNDAIVCNVGHFDCEIDVKWLNTNATKKDTIKPQVDRYTLKNGRHVILLAEGRLVNLGCATGHPSFVMSNSFTNQVLAQVELWTKFGTPQEYKLGLYVLPKTLDEEVAYLHLAQLGVKLTKLSDEQASYLGVPVAGPYKPDHYRY

SEQ ID NO: 1026 - protein, 935 aa, Rattus norvegicus
MAPAGILNGKVVSAQIRNRLKTQVTQMQEQVPGFTPGLAILQVGDRDDSNLYINVKLKAAQEIGIKATHIKLPRTSTESEVLKYVISLNEDATVHGFIVQLPLDSENSINTEAVINAIAPEKDVDGLTSINAGKLARGDLKDCFIPCTPKGCLELIKETGVQIAGRHAVVVGRSKIVGAPMHDLLLWNNATVTTCHSKTADLDKEVNKGDILVVATGQPEMVKGEWIKPGAVVIDCGINYVPDDTKPNGRKVVGDVAYDEAKEKASFITPVPGGVGPMTVAMLMQSTVESAQRFLKKFKPGKWTIQYNKLNLKTPVPSDIAISRSCKPKLIGNLAREIGLLTEEVELYGETKAKVLLSALDRLKHQPDGKYVVVTGITPTPLGEGKSTTTIGLVQALGAHLHQNVFACVRQPSQGPTFGIKGGAAGGGYSQVIPMEEFNLHLTGDIHAITAANNLVAAAIDARIFHELTQTDKALFNRLVPSVNGVRKFSDIQIRRLRRLGIEKTDPAALTDDEINRFARLDIDPETITWQRVLDTNDRFLRKITIGQAPTEKGHTRTAQFDISVASEIMAVLALTSSLEDMRARLGKMVVASSKKGEPISCEDLGVSGALTVLMKDAIKPNLMQTLEGTPVFVHAGPFANIAHGNSSIIADRIALKLVGPEGFVVTEAGFGADIGMEKFFNIKCRYSGLQPHVVVLVATVRALKMHGGGPTVTAGLPLPKAYTEEDLDLVEKGFSNLRKQIENARMFGVPVVVAMNAFKTDTDTELDLIGRLSREHGAFDAVKCTHWAEGGQGALALAQAVQRASQAPSSFQLLYDLKLSVEDKIRIIAQKIYGADDIELLPEAQNKAEIYTKQGFGNLPICMAKTHLSLSHNPEQKGVPTGFVLPIRDIRASVGAGFLYPLVGTMSTMPGLPTRPCFYDIDLDPETEQVNGLF

SEQ ID NO: 1027 - protein, 160 aa, Rattus norvegicus; identical to SEQ ID NO: 447

SEQ ID NO: 1028 - protein, 160 aa, Rattus norvegicus; identical to SEQ ID NO: 447

SEQ ID NO: 1029 - protein, 160 aa, Rattus norvegicus; identical to SEQ ID NO: 447

SEQ ID NO: 1030 - protein, 160 aa, Rattus norvegicus; identical to SEQ ID NO: 447

SEQ ID NO: 1031 - protein, 160 aa, Rattus norvegicus; identical to SEQ ID NO: 447

SEQ ID NO: 1032 - protein, 160 aa, Rattus norvegicus; identical to SEQ ID NO: 447

SEQ ID NO: 1033 - protein, 160 aa, Rattus norvegicus; identical to SEQ ID NO: 447

SEQ ID NO: 1034 - protein, 160 aa, Rattus norvegicus; identical to SEQ ID NO: 447

SEQ ID NO: 1035 - protein, 323 aa, Sporobolomyces salmonicolor
MVGTTTLNTGASLELVGYGTWQAAPGEVGQGVKVAIETGYRHLDLAKVYSNQPEVGAAIKEAGVKREDLFITSKLWNNSHRPEQVEPALDDTLKELGLEYLDLYLIHWPVAFPPEGDITQNLFPKANDKEVKLDLEVSLVDTWKAMVKLLDTGKVKAIGVSNFDAKMVDAIIEATGVTPSVNQIERHPLLLQPELIAHHKAKNIHITAYSPLGNNTVGAPLLVQHPEIKRIAEKNGCTPAQVLIAWAIVGGHSVIPKSVTPSRIGENFKQVSLSQEDVDAVSKLGEGSGRRRYNIPCTYSPKWDINVFGEEDEKSCKNAVKIK

SEQ ID NO: 1036 - protein, 146 aa, Medicago truncatula
MGFTEKQEALVNSSWELFKQNPGNSVLFYTIILEKAPAAKGMFSFLKDTAGVQDSPKLQSHAEKVFGMVRDSAVQLRATGGVVLGDATLGAIHIQKGVVDPHFVVVKEALLKTIKEVSGDKWSEELSTAWEVAYDALAAAIKKAMG

SEQ ID NO: 1037 - protein, 365 aa, Medicago sativa
MGSTGETQITPTHISDEEANLFAMQLASASVLPMILKSALELDLLEIIAKAGPGAQISPIEIASQLPTTNPDAPVMLDRMLRLLACYIILTCSVRTQQDGKVQRLYGLATVAKYLVKNEDGVSISALNLMNQDKVLMESWYHLKDAVLDGGIPFNKAYGMTAFEYHGTDPRFNKVFNKGMSDHSTITMKKILETYTGFEGLKSLVDVGGGTGAVINTIVSKYPTIKGINFDLPHVIEDAPSYPGVEHVGGDMFVSIPKADAVFMKWICHDWSDEHCLKFLKNCYEALPDNGKVIVAECILPVAPDSSLATKGVVHIDVIMLAHNPGGKERTQKEFEDLAKGAGFQGFKVHCNAFNTYIMEFLKKV

SEQ ID NO: 1038 - protein, 137 aa, Bos taurus
KGIGVPKWTAVEIVLIWVVSVVLAVPEAVGFDIITSDHIGNKLRICLLHPTQKTAFMQFYKTAKDWWLFSFYFCLPLAITALFYTLMTCEMLRKKSGMQIALNDHLKQRREVAKTVFCLVLVFALCWLPLHLSRILK

SEQ ID NO: 1039 - protein, 107 aa, Bos taurus
AVEIVLIWVVSVVLAVPEAVGFDIITSDHIGNKLRICLLHPTQKTAFMQFYKTAKDWWLFSFYFCLPLAITALFYTLMTCEMLRKKSGMQIALNDHLKQRREVAKTV

SEQ ID NO: 1040 - protein, 271 aa, Rattus norvegicus
MNWSVFEGLLSGVNKYSTAFGRIWLSLVFVFRVLVYLVTAERVWGDDQKDFDCNTRQPGCTNVCYDEFFPVSHVRLWALQLILVTCPSLLVVMHVAYRKAREKKYQQEVGKGYLYPNPGKKRGGLWWTYVCSLLFKATIDIIFLYLFHAFYPRYTLPSMVKCHSAPCPNTVDCFIAKPSEKNIFIVFMLVTAIVCILLNLVELLYLVIKRCSECAPAKRPPTAHAKNDPNWANPSSKEKDFLSSDLIFLGSDTHPPLLPDRPRAHVKKTIL

SEQ ID NO: 1041 - protein, 579 aa, Saccharomyces cerevisiae
MKYVVVSGGVISGIGKGVLASSTGMLMKTLGLKVTSIKIDPYMNIDAGTMSPLEHGECFVLDDGGETDLDLGNYERYLGVTLTKDHNITTGKIYSHVIAKERKGDYLGKTVQIVPHLTNAIQDWIERVAKIPVDDTGMEPDVCIIELGGTVGDIESAPFVEALRQFQFKVGKENFALIHVSLVPVIHGEQKTKPTQAAIKGLRSLGLVPDMIACRCSETLDKPTIDKIAMFCHVGPEQVVNVHDVNSTYHVPLLLLEQKMIDYLHARLKLDEISLTEEEKQRGLELLSKWKATTGNFDESMETVKIALVGKYTNLKDSYLSVIKALEHSSMKCRRKLDIKWVEATDLEPEAQESNKTKFHEAWNMVSTADGILIPGGFGVRGTEGMVLAARWARENHIPFLGVCLGLQIATIEFTRSVLGRKDSHSAEFYPDIDEKNHVVVFMPEIDKETMGGSMRLGLRPTFFQNETEWSQIKKLYGDVSEVHERHRHRYEINPKMVDELENNGLIFVGKDDTGKRCEILELKNHPYYIATQYHPEYTSKVLDPSKPFLGLVAASAGILQDVIEGKYDLEAGENKFNF

SEQ ID NO: 1042 - protein, 153 aa, Saccharomyces cerevisiae
QFKVGKENFALIHVSLVPVIHGEQKTKPTQAAIKGLRSLGLVPDMIACRCSETLDKPTIDKIAMFCHVGPEQVVNVHDVNSTYHVPLLLLEQKMIDYLHARLKLDEISLTEEEKQRGLELLSKWKATTGNFDESMETVKIALVGKYTNLKDSY

SEQ ID NO: 1043 - protein, 99 aa, Saccharomyces cerevisiae
IDKIAMFCHVGPEQVVNVHDVNSTYHVPLLLLEQKMIDYLHARLKLDEISLTEEEKQRGLELLSKWKATTGNFDESMETVKIALVGKYTNLKDSYLSVI

SEQ ID NO: 1044 - protein, 68 aa, Macaca mulatta
HEACGTSVIVGVPPDSQNLSINPMLLLTGRTWKGAVYGGFKSKEDIPKLVADFMAKKFSLDALITHVL

SEQ ID NO: 1045 - protein, 75 aa, Macaca mulatta
HEACGTSVIVGVPPDSQNLSINPMLLLTGRTWKGAVYGGFKSKEDIPKLVADFMAKKFSLDALITHVLPFEKINE

SEQ ID NO: 1046 - protein, 310 aa, Malus domestica
MSTVTLSSGYEMPVIGLGLWRLEKDELKEVILNAIKIGYRHFDCAAHYKSEADVGEALAEAFKTGLVKREELFITTKIWNSDHGHVVEACKNSLEKLQIDYLDLYLVHYPMPTKHNAIGKTASLLGEDKVLDIDVTISLQQTWEGMEKTVSLGLVRSIGLSNYELFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVYA

SEQ ID NO: 1047 - protein, 238 aa, Rattus norvegicus
MAVEGGMKCVKFLLYVLLLAFCACAVGLIAIGVAVQVVLKQAITHETTAGSLLPVVIIAVGAFLFLVAFVGCCGACKENYCLMITFAIFLSLIMLVEVAVAIAGYVFRDQVKSEFSKSFQKQMQNYLTDNKTATILDKLQKENKCCGASNYTDWERIPGMAKDRVPDSCCINITVGCGNDFKESTIHTQGCVETIAAWLRKNVLLVAGAALGIAFVEVLGIIFSCCLVKSIRSGYEVM

SEQ ID NO: 1048 - protein, 116 aa, Mus musculus
TGPGLVRMVEVCVESIKQHLDRLGEVTDTSGYVDVLTLMRHIMLDTSNMLFLGIPLDESAIVKKIQGYFNAWQALLIKPNIFFKISWLYRKYERSVKDLKDEIAVLVEKKRHKVST

SEQ ID NO: 1049 - protein, 176 aa, Mus musculus
VESIKQHLDRLGEVTDTSGYVDVLTLMRHIMLDTSNMLFLGIPLDESAIVKKIQGYFNAWQALLIKPNIFFKISWLYRKYERSVKDLKDEIAVLVEKKRHKVSTAEKLEDCMDFATDLIFAERRGDLTKENVNQCILEMLIAAPDTMSVTLYFMLLLVAEYPEVEAAILKEIHTVV

SEQ ID NO: 1050 - protein, 1476 aa, Mus musculus
MWKSRRAQLCLFSVLLAFLHSASLLNGDSKYMVLVPSQLYTETPEKICLHLYQLNETVTVTASLVSQSGRKNLFDELVLDKDLFQCVSFIIPRLSSSDEEDFLYVDIKGPTHEFSKRKAVLVKNKESVVFVQTDKPVYKPGQSVKFRVVSMDKMLRPLNELLPLAYIEDPKKNRIMQWRDIKTENGLKQMSFSLAAEPIQGPYKIVVHKESGEKEEHSFTVMEFVLPRFNVDLKVPNAMSVNDEVLSVTACGKYTYGKPVPGHVKINVCRETETGCREVNSQLDNNGCSTQEVNITELQSKKRNYEVQLFHVNATVTEEGTGLEFSRSGTTKIERITNKLIFLKADSHFRHGIPFFVKVRLVDIKGDPIPNEKVFIKAQELSYTSATTTDQHGLAEFSIDTTCISGSSLHIKVNHKEEDSCSYFYCMEERHASAKHVAYAVYSLSKSYIYLDTETSSILPCNQIHTVQAHFILKGDLGVLKELIFYYLVMAQGSIIQTGNHTHQVEPGEAPVKGKFALEIPVEFSMVPMAKMLIYTILPDGEVIADSVNFEIEKCLRNKVDLRFSTSQSLPASQTRLQVTASPQSLCGLRAVDQSVLLLKPESELSPSWIYNLPGMQQNKFVPSSRLSEDQEDCILYSSWLAEKHTNLVPHGTEKDVYRYVEDMGLTAFTNLMIKLPIICFDYGMVPISAPRVEFDLAFTPEISWSLRTTLSKRPEEPPRKDPSSNDPLTETIRKYFPETWVWDIVTVNSTGLAEVEMTVPDTITEWKAGALCLSNDTGLGLSSVVPLQAFKPFFVEVSLPYSVVRGEAFMLKATVMNYLPTSMQMSVQLEASPDFTAVPVGDDQDSYCLSANGRHTSSWLVTPKSLGNVNFSVSAEAQQSSEPCGSEVATVPETGRKDTVVKVLIVEPEGIKQEHTFSSLFCASDAEISEKMSLVLPPTVVKDSARAHFSVMGDILSSAIRNTQNLLHMPYGCGEQNMVLFAPNIYVLKYLNETQQLTQKIKTKALGFLRAGYQRELNYKHKDGSYSAFGDQNGEREGNTWLTAFVLKSFAQARAFIFIDESHITHAFTWLSQKQKDNGCFRSSGSLFNNAMKGGVDDEMTLSAYITMALLESSLPATHPVVSKALSCLESSWKTIEQERNASFVYTKALMAYAFALAGNQNKRDEILKSLDEEAIKENNSIHWKRPQKSRKSEHHLYKPQASSAEVEMNAYVVLARLTAQPAPSPEDLTLSMSTIMWLTKQQNSNGGFSSTQDTVVALDALSKYGAVTFSRSQKTTLVTIQSTGSFSQKFQVENSNRLLLQQVALPDIPGDYTISVSGEGCVYAQTMLRYNMHLEKQLSAFAIWVQTVPLTCNNPKGHNSFQISLEISYTGSRPASNMVIADVKMLSGFIPLKPTVKKLERLEHVSRTEVSNNNVLIYLDQVTNQTLAFSFIIQQDIPVRNLQPAIVKVYDYYETDEMAFAEYSSPCSTDKQNV

SEQ ID NO: 1051 - protein, 715 aa, Pseudomonas fragi
MIYEGKAITVTALESGIVELKFDLKGESVNKFNRLTLNELRQAVDAIKADASVKGVIVSSGKDVFIVGADITEFVENFKLPDAELIAGNLEANKIFSDFEDLNVPTVAAINGIALGGGLEMCLAADFRVMADSAKIGLPEVKLGIYPGFGGTVRLPRLIGVDNAVEWIASGKENRAEDALKVSAVDAVVTADKLGAAALDLIKRAISGELDYKAKRQPKLEKLKLNAIEQMMAFETAKGFVAGQAGPNYPAPVEAIKTIQKAANFGRDKALEVEAAGFAKLAKTSASNCLIGLFLNDQELKKKAKVYDKIAKDVKQAAVLGAGIMGGGIAYQSASKGTPILMKDINEHGIEQGLAEAAKLLVGRVDKGRMTPAKMAEVLNGIRPTLSYGDFGNVDLVVEAVVENPKVKQAVLAEVENHVREDAILASNTSTISISLLAKALKRPENFVGMHFFNPVHMMPLVEVIRGEKSSDLAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDDRRSAIDALYEAKRLGQKNGKGFYAYEADKKGKQKKLVDSSVLEVLKPIVYEQRDVTDEDIINWMMIPLCLETVRCLEDGIVETAAEADMGLVYGIGFPLFRGGALRYIDSIGVAEFVALADQYAELGALYHPTAKLREMAKNGQSFFG

SEQ ID NO: 1052 - protein, 399 aa, Gallus gallus
MALTRRAAVMRGVENAVTGHNTKAKVQVTGKRAVLEEIGNKVARGSNVPKKTDCIKPPVKATKGPGKMTNTVVPPKPPAAVNQAVKDTTTASKVLSPVPMDVSMQEEDLCQAFSDVLLHNIEDIDADDSGNPQLCSDYVKDIYLYLRQLELQQSVRPHYLDGKTINGRMRAILVDWLVQVHSRFQLLQETLYMCVAVMDRFLQSHPVPRKRLQLVGVTALLLASKYEEMYSPDIADFVYITDNAYNSAEVREMEITILKELNFDLGRPLPLHFLRRASKAGEADAEQHTLAKYLMELTLIDYDMVHYHPSEIAAAALCLSQKVLGHDKWGTKQQYYTGYAEDSLAMTMKHMAKNVVKVNENLTKYTAVRNKYASSKLLRISTISQLNSKTIKDLAASLL

SEQ ID NO: 1053 - protein, 433 aa, Spinacia oleracea
GASFSLHVLSKINSYKSQSTKPIRGVASMAKKSVGDLTSADLKGKKVFVRADLNVPLDDSQNITDDTRIRAAIPTIKHLINNGAKVILSSHLGRPKGVTPKFSLAPLVPRLSELLGLQVVKADDCIGPDVEKLVAELPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGMSVGSSLVEEDKLDLATSLLAKAKEKGVSLLLPTDVVIADKFAADADSKIVPASGIPDGWMGLDIGPDSIKTFSEALDTTQTVIWNGPMGVFEFEKFAAGTEAIAKKLEEISKKGATTIIGGGDSVAAVEKVGVAEAMSHISTGGGASLELLEGKQLPGVLALNEADPVPV

SEQ ID NO: 1054 - protein, 47 aa, Gallus gallus
PHTVDCFISRPTEKTIFIIFMLVVASVSLLLNMLEIYHLGWKKLKQG

SEQ ID NO: 1055 - protein, 32 aa, Gallus gallus
TEKTIFIIFMLVVASVSLLLNMLEIYHLGWKK

SEQ ID NO: 1056 - protein, 114 aa, Arabidopsis thaliana
MASEEGQVIACHTVETWNEQLQKANESKTLVVVDFTASWCGPCRFIAPFFADLAKKLPNVLFLKVDTDELKSVASDWAIQAMPTFMFLKEGKILDKVVGAKKDELQSTIAKHLA

SEQ ID NO: 1057 - protein, 292 aa, Oryza sativa
MEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVTLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 1058 - protein, 417 aa, Mus musculus
MAFIVALGLVITGICPGVLCFPDGTLERDTLFHKDKENGTQLDSLTLASINTDFAFSLYKKLALKNPDTNIVFSPLSISAALAIVSLGAKGNTLEEILEGLNFNLTETPEADIHQGFGHLLQRLSHPGEQVQISTGSALFVEKHLQILAEFQEKARALYQAEAFTADFQQPLEATKLINDYVSNQTQRKIKGLISDLDTDTLMVLVNYIYFKGKWKMPFNPRDTFESEFYLDVKRSVKVPMMKIKTLTTPYFRDEELSCTVVELKYKGNASALFILPDQGRMQQVEASLQPETLRKWKNSLRPRKMGELYLPKFSISTDYSLKNILPELGIKEIFSKQADLSGITGTKDLIVSQMVHKAVLDVAETGTEGVAATGVNFRILSRRTSLWFNRTFLMVISHTDVQTTLFIAKITHPKRA

SEQ ID NO: 1059 - protein, 147 aa, Gymnodraco acuticeps
MVNWTKTEKATITDIFSHLDYDDIGPKALSRCLIVYPWTQRYFSGFGNLYNAAAIIGNAKVAEHGIKVLHGLDLGLKKMDNIEAAYADLSSLHSEKLHVDPDNFKLLSDCITIVLAAKLGSAFTAETQATFQKFLGAVMSALGKQYH

SEQ ID NO: 1060 - protein, 147 aa, Mesocricetus auratus
MVHFTAEEKAAITSIWDKVDLEKAGGETLGRLLIVYPWTQRFFEKFGNLSPPQAIMGNPRIRAHGKKVLTSLGLAVQNMDNLKETFAHLSELHCDKLHVDPENFKLLGNMLVIVLSSHLGKEFTAEVQAAWQKLVAAVANALSLKYH

SEQ ID NO: 1061 - protein, 389 aa, Medicago sativa
MVSVAEIRQAQRAEGPATIMAIGTANPANCVEQSTYPDFYFKITNSEHKVELKEKFQRMCDKSMIKRRYMYLTEEILKDNPRVCEYMAPSLAARQDMAVVVVPRLGKEAAVKAIKEWGQPKSKITHLIFCTTSGVDMPGADYQLTKLLGLRPYVKRYMMYQQGCFAGGTVLRLAKDLAENNKGARVLVVCSEETPVTFRGPSDTHLDSLVGQALFGDGAAALIVGSDPIPEIEKPIFEMVWTAHTIAPDSEGAIDGHLREAGLTFHLLKDVPGIVSKNIDKALIEAFQPLNISDYNSIFWIAHPGGPAILDQVEEKLGLKPEKMKATREVLSEYGNMSSACVLFILDEMRKKSVQAGLKTTGEGLDWGVLFGFGPGLTIETVVLHSVAI

SEQ ID NO: 1062 - protein, 389 aa, Medicago sativa
MVSVSEIRKAQRAEGPATILAIGTANPANCVEQSTYPDFYFKITNSEHKTELKEKFQRMCDKSMIKRRYMYLTEEILKENPNVCEYMAPSLDARQDMVVVEVPRLGKEAAVKAIKEWGQPKSKITHLIVCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNITKALVEAFEPLGISDYNSIFWIAHPGGPAILDQVEQKLALKPEKMNATREVLSEYGNMSSACVLFILDEMRKKSTQNGLKTTGEGLEWGVLFGFGPGLTIETVVLRSVAI

SEQ ID NO: 1063 - protein, 389 aa, Medicago sativa
MVSVSEIRTAQRAEGPATILAIGTANPANCVEQSTYPDFYFKITNSEHKTELKEKFQRMCDKSMIKRRYMYLTEEILKENPSVCEYMAPSLDARQDMVVVEVPRLGKEAAVKAIKEWGQPKSKITHLIVCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGGIDGHLREAGLTFHLLKDVPGIVSKNINKALVEAFEPLGISDYNSIFWIAHPGGPAILDQVEQKLALKPEKMKATREVLSEYGNMSSACVLVILDEMRKKSAQDGLKTTGEGLEFGVLFGFGPGLTIETVVLRSVAI

SEQ ID NO: 1064 - protein, 389 aa, Medicago sativa
MVSVSEIRQAQRAEGPATIMAIGTANPANCVEQSTYPDFYFKITNSEHKVELKEKFQRMCDKSMIKRRYMYLTEEILKENPSVCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPIPEIEKPIFEMVWTAQTIAPDSEGAIDGHLREAGLTFHLLKDVPGIVSKNIDKALVEAFQPLNISDYNSIFWIAHPGGPAILDQVEQKLGLKPEKMKATREVLSEYGNMSSACVLFILDEMRKKSAQAGLKTTGEGLDWGVLFGFGPGLTIETVVLHSVAI

SEQ ID NO: 1065 - protein, 232 aa, Malus domestica
MMYQQGCFAGGTVLRLAKDLAENNKGARVLVVCSEITAVTFRGPSDTHLDSLVGQALFGDGAAAVIIGADPVPEVEKPLFELVSAAQTVLPDSDGAIDGHLREVGLTFHLLKDVPGLISKNIEKSLNEALKPIGISDWNSLFWIAHPGGPAILDQVEAKLALKPEKLEATRQVLSDYGNMSSACVLFILDEVRRKSAEKGLETTGEGLEWGVLFGFGPGLTVETVVLHSVAA

SEQ ID NO: 1066 - protein, 213 aa, Nicotiana tabacum
MAIKVHGSPMSTATMRVAACLIEKELDFEFVPVDMASGEHKKHPYLSLNPFGQVPAFEDGDLKLFESRAITQYIAHVYADNGYQLILQDPKKMPSMSVWMEVEGQKFEPPATKLTWELGIKPIIGMTTDDAAVKESEAQLSKVLDIYETQLAESKYLGGDSFTLVDLHHIPNIYYLMSSKVKEVFDSRPRVSAWCADILARPAWVKGLEKLQK

SEQ ID NO: 1067 - protein, 520 aa, Arabidopsis thaliana
MAHTLGLTQPNSTEPHKISFTAKEIDVIEWKGDILVVGVTEKDLAKDGNSKFENPILSKVDAHLSGLLAQVSSEEDFTGKPGQSTVLRLPGLGSKRIALIGLGQSVSSPVAFHSLGEAVATVSKASQSTSAAIVLASSVSDESKLSSVSALASGIVLGLFEDGRYKSESKKPSLKAVDIIGFGTGAEVEKKLKYAEDVSYGVIFGRELINSPANVLTPAVLAEEAAKVASTYSDVFTANILNEEQCKELKMGSYLAVAAASANPPHFIHLVYKPPNGSVKTKLALVGKGLTFDSGGYNIKTGPGCSIELMKFDMGGSAAVLGAAKAIGEIKPPGVEVHFIVAACENMISGTGMRPGDVITASNGKTIEVNNTDAEGRLTLADALVYACNQGVDKIVDLATLTGACVIALGTSMAGIYTPSDELAKEVIAASERSGEKLWRMPLEESYWEMMKSGVADMVNTGGRAGGSITAALFLKQFVSEKVQWMHIDMAGPVWNEKKKSGTGFGVATLVEWVQKNSSS

SEQ ID NO: 1068 - protein, 423 aa, Rattus norvegicus
MALRVTRNTKINTENKAKVSMAGAKRVPVAVAASKPLLRSRTALGDIGNKVSEQSRIPLKKETKKLGSGTVTVKALPKPVDKVPVCEPEVELDEPEPEPVMEVKHSPEPILVDTPSPSPMETSGCAPAEEYLCQAFSDVILAVSDVDADDGGDPNLCSEYVKDIYAYLRQLEEEQSVRPKYLLGREVTGNMRAILIDWLIQVQMKFRLLQETMYMTVSIIDRFMQDSCVPKKMLQLVGVTAMFIASKYEEMYPPEIGDFAFVTNNTYTKHQIRQMEMKILRVLNFSLGRPLPLHFLRRASKIGEVDVEQHTLAKYLMELSMLDYDMVHFAPSQIAAGAFCLALKILDNGEWTPTLQHYLSHTEESLLPVMQHLAKNIVMVNRGLTKHMTIKNKYATSKHAKISTLAQLNCTLVQNLSKAVTKA

SEQ ID NO: 1069 - protein, 92 aa, Felis catus
MKGACVLVLLWAALLLISGGNCEICPAVKRDVDLFLTGTPDEYVEQVAQYKALPVVLENARILKNCVDAKMTEEDKENALSVLDKIYTSPLC

SEQ ID NO: 1070 - protein, 110 aa, Saccharomyces cerevisiae
HRYRVLFLVGTYTIGKEKLAIKICEFLKTKLFVMPNSVKFSMMLTVLQNNENQNDMWDESLLTSNLHESSVHLVPIRVLKSQETIEAYLKSLKELETDYVKDIEDVVGFI

SEQ ID NO: 1071 - protein, 113 aa, Saccharomyces cerevisiae
RVLFLVGTYTIGKEKLAIKICEFLKTKLFVMPNSVKFSMMLTVLQNNENQNDMWDESLLTSNLHESSVHLVPIRVLKSQETIEAYLKSLKELETDYVKDIEDVVGFIPTGWSH

SEQ ID NO: 1072 - protein, 700 aa, Saccharomyces cerevisiae
MVAQYTVPVGKAANEHETAPRRNYQCREKPLVRPPNTKCSTVYEFVLECFQKNKNSNAMGWRDVKEIHEESKSVMKKVDGKETSVEKKWMYYELSHYHYNSFDQLTDIMHEIGRGLVKIGLKPNDDDKLHLYAATSHKWMKMFLGAQSQGIPVVTAYDTLGEKGLIHSLVQTGSKAIFTDNSLLPSLIKPVQAAQDVKYIIHFDSISSEDRRQSGKIYQSAHDAINRIKEVRPDIKTFSFDDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGALGNLVFKKIRTATGGQLRYLLNGGSPISRDAQEFITNLICPMLIGYGLTETCASTTILDPANFELGVAGDLTGCVTVKLVDVEELGYFAKNNQGEVWITGANVTPEYYKNEEETSQALTSDGWFKTGDIGEWEANGHLKIIDRKKNLVKTMNGEYIALEKLESVYRSNEYVANICVYADQSKTKPVGIIVPNHAPLTKLAKKLGIMEQKDSSINIENYLEDAKLIKAVYSDLLKTGKDQGLVGIELLAGIVFFDGEWTPQNGFVTSAQKLKRKDILNAVKDKVDAVYSSS

SEQ ID NO: 1073 - protein, 33 aa, Saccharomyces cerevisiae
KWMKMFLGAQSQGIPVVTAYDTLGEKGLIHSLV

SEQ ID NO: 1074 - protein, 171 aa, Saccharomyces cerevisiae
DDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGAL

SEQ ID NO: 1075 - protein, 221 aa, Rattus norvegicus
MAIQLRVFYLVPLLLASYVQTTPRLEKMKMDCYKDVKGTIYNYEALSLNGKERIPFKQYAGKHVLFVNVATYCGLTIQYPELNALQDDLKQFGLVILGFPCNQFGKQEPGDNTEILPGLKYVRPGKGFLPNFQLFAKGDVNGEKEQEIFTFLKRSCPHPSETVVTSKHTFWEPIKVHDIRWNFEKFLVGPNGVPVMRWFHQAPVSTVKSDILAYLNQFKTI

SEQ ID NO: 1076 - protein, 34 aa, Sus scrofa
  MOD_RES (2)..(2): Any amino acid
  MOD_RES (15)..(15): Any amino acid
SXPLPLIVNTWPFKXATTIGMVVIHLKGYTAAGT

SEQ ID NO: 1077 - protein, 50 aa, Drosophila melanogaster
VHPLKRRTSRRKVRIILVLIWALSCVLSAPCLLYSSIMTKHYYNGKSRTV

SEQ ID NO: 1078 - protein, 39 aa, Drosophila melanogaster
KVRIILVLIWALSCVLSAPCLLYSSIMTKHYYNGKSRTV

SEQ ID NO: 1079 - protein, 553 aa, Desulfovibrio vulgaris
MFCFQCQETAKNTGCTVKGMCGKPEETANLQDLLIFVLRGIAIYGEKLKELGQPDRSNDDFVLQGLFATITNANWDDARFEAMISEGLARRDKLRNAFLAVYKAKNGKDFSEPLPEAATWTGDSTAFAEKAKSVGILATENEDVRSLRELLIIGLKGVAAYAEHAAVLGFRKTEIDEFMLEALASTTKDLSVDEMVALVMKAGGMAVTTMALLDEANTTTYGNPEITQVNIGVGKNPGILISGHDLKDMAELLKQTEGTGVDVYTHGEMLPANYYPAFKKYPHFVGNYGGSWWQQNPEFESFNGPILLTTNCLVPLKKENTYLDRLYTTGVVGYEGAKHIADRPAGGAKDFSALIAQAKKCPPPVEIETGSIVGGFAHHQVLALADKVVEAVKSGAIKRFVVMAGCDGRQKSRSYYTEVAENLPKDTVILTAGCAKYRYNKLNLGDIGGIPRVLDAGQCNDSYSLAVIALKLKEVFGLDDINDLPVSYDIAWYEQKAVAVLLALLFLGVKGIRLGPTLPAFLSPNVAKVLVENFNIKPIGTVQDDIAAMMAGK

SEQ ID NO: 1080 - protein, 341 aa, Bos taurus
MDTVRIAVVGAGVMGLSTAVCISKMVPGCSITVISDKFTPETTSDVAAGMLIPPTYPDTPIQKQKQWFKETFDHLFAIVNSAEAEDAGVILVSGWQIFQSIPTEEVPYWADVVLGFRKMTKDELKKFPQHVFGHAFTTLKCEGPAYLPWLQKRVKGNGGLILTRRIEDLWELHPSFDIVVNCSGLGSRQLAGDSKIFPVRGQVLKVQAPWVKHFIRDSSGLTYIYPGVSNVTLGGTRQKGDWNLSPDAEISKEILSRCCALEPSLRGAYDLREKVGLRPTRPSVRLEKELLAQDSRRLPVVHHYGHGSGGIAMHWGTALEATRLVNECVQVLRTPAPKSKL

SEQ ID NO: 1081 - protein, 78 aa, Schizosaccharomyces pombe
IQLGVNESLYDTSKVISSMVSGIVARVNKYSDVATLAKHASCPVINGLCDTFHPLQALADLLTIKETFKSFDGLKVAW

SEQ ID NO: 1082 - protein, 87 aa, Schizosaccharomyces pombe
LYDTSKVISSMVSGIVARVNKYSDVATLAKHASCPVINGLCDTFHPLQALADLLTIKETFKSFDGLKVAWVGDANNVLHDLMIANAK

SEQ ID NO: 1083 - protein, 593 aa, Gallus gallus
MAARQQLALLSVSEKAGLVEFARSLNALGLGLIASGGTATALRDAGLPVRDVSDLTGFPEMLGGRVKTLHPAVHAGILARNIPEDNADMNKQDFSLVRVVVCNLYPFVKTVSSPGVTVPEAVEKIDIGGVALLRAAAKNHARVTVVCDPADYSSVAKEMAASKDKDTSVETRRHLALKAFTHTAQYDAAISDYFRKEYSKGVSQLPLRYGMNPHQSPAQLYTTRPKLPLTVVNGSPGFINLCDALNAWQLVKELKQALGIPAAASFKHVSPAGAAVGIPLSEEEAQVCMVHDLHKTLTPLASAYARSRGADRMSSFGDFIALSDICDVPTAKIISREVSDGVVAPGYEEEALKILSKKKNGGYCVLQMDPNYEPDDNEIRTLYGLQLMQKRNNAVIDRSLFKNIVTKNKTLPESAVRDLIVASIAVKYTQSNSVCYAKDGQVIGIGAGQQSRIHCTRLAGDKANSWWLRHHPRVLSMKFKAGVKRAEVSNAIDQYVTGTIGEDEDLVKWQAMFEEVPAQLTEAEKKQWIAKLTAVSLSSDAFFPFRDNVDRAKRIGVQFIVAPSGSAADEVVIEACNELGITLIHTNLRLFHH

SEQ ID NO: 1084 - protein, 75 aa, Saccharomyces cerevisiae
NETKLDELIHSVGFHTRKAKYILSTCKILQDQFSSDVPATINELLGLPGVGPKMAYLTLQKAWGKIEGICVDVHV

SEQ ID NO: 1085 - protein, 67 aa, Saccharomyces cerevisiae
VGFHTRKAKYILSTCKILQDQFSSDVPATINELLGLPGVGPKMAYLTLQKAWGKIEGICVDVHVDRL

SEQ ID NO: 1086 - protein, 573 aa, Rattus norvegicus
MASTEGANNMPKQVEVRMHDSHLSSEEPKHRNLGMRMCDKLGKNLLLSLTVFGVILGAVCGGLLRLAAPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPSEEANTTKAVISLLNETMNEAPEETKIVIKKGLEFKDGMNVLGLIGFFIAFGIAMGKMGEQAKLMVEFFNILNEIVMKLVIMIMWYSPLGIACLICGKIIAIKDLEVVARQLGMYMITVIVGLIIHGGIFLPLIYFVVTRKNPFSFFAGIFQAWITALGTASSAGTLPVTFRCLEDNLGIDKRVTRFVLPVGATINMDGTALYEAVAAIFIAQMNGVILDGGQIVTVSLTATLASIGAASIPSAGLVTMLLILTAVGLPTEDISLLVAVDWLLDRMRTSVNVVGDSFGAGIVYHLSKSELDTIDSQHRMHEDIEMTKTQSVYDDTKNHRESNSNQCVYAAHNSVVIDECKVTLAANGKSADCSVEEEPWKREK

SEQ ID NO: 1087 - protein, 570 aa, Rattus norvegicus
MVSANNMPKQVEVRMHDSHLSSEEPKHRNLGMRMCDKLGKNLLLSLTVFGVILGAVCGGLLRLAAPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPSEEANTTKAVISLLNETMNEAPEETKIVIKKGLEFKDGMNVLGLIGFFIAFGIAMGKMGEQAKLMVEFFNILNEIVMKLVIMIMWYSPLGIACLICGKIIAIKDLEVVARQLGMYMITVIVGLIIHGGIFLPLIYFVVTRKNPFSFFAGIFQAWITALGTASSAGTLPVTFRCLEDNLGIDKRVTRFVLPVGATINMDGTALYEAVAAIFIAQMNGVILDGGQIVTVSLTATLASIGAASIPSAGLVTMLLILTAVGLPTEDISLLVAVDWLLDRMRTSVNVVGDSFGAGIVYHLSKSELDTIDSQHRMHEDIEMTKTQSVYDDTKNHRESNSNQCVYAAHNSVVIDECKVTLAANGKSADCSVEEEPWKREK

SEQ ID NO: 1088 - protein, 131 aa, Klebsiella pneumoniae
AAVLDIIGKKHTWLSGEGELVRKASFKVEEDEKTGQITHRETAVGLVLSTTCFLLAYVVAKKILPSIGGVAIHYFAWMVLIVAALNASGLCSPEIKAGAKRLSDFFSKQLLWVLMVGVGVCYTDLQEIINA

SEQ ID NO: 1089 - protein, 115 aa, Klebsiella pneumoniae
IGKKHTWLSGEGELVRKASFKVEEDEKTGQITHRETAVGLVLSTTCFLLAYVVAKKILPSIGGVAIHYFAWMVLIVAALNASGLCSPEIKAGAKRLSDFFSKQLLWVLMVGVGVC

SEQ ID NO: 1090 - protein, 356 aa, Eucalyptus gunnii
MGSLEKERTTTGWAARDPSGVLSPYTYSLRNTGPEDLYIKVLSCGVCHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 1091 - protein, 358 aa, Medicago sativa
MGSIEAAERTTVGLAAKDPSGILTPYTYTLRNTGPDDVYIKIHYCGVCHSDLHQIKNDLGMSNYPMVPGHEVVGEVLEVGSNVTRFKVGEIVGVGLLVGCCKSCRACDSEIEQYCNKKIWSYNDVYTDGKITQGGFAESTVVEQKFVVKIPEGLAPEQVAPLLCAGVTVYSPLSHFGLKTPGLRGGILGLGGVGHMGVKVAKALGHHVTVISSSDKKKKEALEDLGADNYLVSSDTVGMQEAADSLDYIIDTVPVGHPLEPYLSLLKIDGKLILMGVINTPLQFVTPMVMLGRKSITGSFVGSVKETEEMLEFWKEKGLTSMIEIVTMDYINKAFERLEKNDVRYRFVVDVKGSKFEE

SEQ ID NO: 1092 - protein, 115 aa, Medicago sativa
AKALGHHVTVISSSDKKKKEALEDLGADNYLVSSDTVGMQEAADSLDYIIDTVPVGHPLEPYLSLLKIDGKLILMGVINTPLQFVTPMVMLGRKSITGSFVGSVKETEEMLEFWK

SEQ ID NO: 1093 - protein, 110 aa, Medicago sativa
HHVTVISSSDKKKKEALEDLGADNYLVSSDTVGMQEAADSLDYIIDTVPVGHPLEPYLSLLKIDGKLILMGVINTPLQFVTPMVMLGRKSITGSFVGSVKETEEMLEFWK

SEQ ID NO: 1094 - protein, 562 aa, Glycine max
MITLAPSLDTPKTDQNQVSDPQTSHVFKSKLPDIPISNHLPLHSYCFQNLSQFAHRPCLIVGPASKTFTYADTHLISSKIAAGLSNLGILKGDVVMILLQNSADFVFSFLAISMIGAVATTANPFYTAPEIFKQFTVSKAKLIITQAMYVDKLRNHDGAKLGEDFKVVTVDDPPENCLHFSVLSEANESDVPEVEIHPDDAVAMPFSSGTTGLPKGVILTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELEEALRNRMPQAVLGQGYGMTEAGPVLSMCLGFAKQPFQTKSGSCGTVVRNAELKVVDPETGRSLGYNQPGEICIRGQQIMKGYLNDEAATASTIDSEGWLHTGDVGYVDDDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 1095 - protein, 480 aa, Bos taurus
MAAADALLGSLVTGLYDVQAFKFGNFVLKSGLSSPVYIDLRGIISRPSILNQVAEMLFQTAENAEINFDTVCGVPYTALPLATIVCSTHEIPMLIRRKEKKDYGTKRLIEGAVNPGDTCLIIEDVVSSGSSVWETAEVLQKEGLKVTDAVVLVDREQGGRDNLQARGIRLHSVCTLSTVLCILEQQKKINAETVERVKRFIQENAFVAANPNDSLPSVKKEPKELSFGARAELPGTHPVAAKLLRLMQKKETNLCLSADVSESRELLQLADALGSRICLLKIHVDILNDFTLDVMKELTTLAKRHEFLIFEDRKFADIGNTVKKQYEGGVFKIASWADLVNAHAVPGSGVVKGLEEVGLPLHRACLLVAEMSSAGTLATGSYTEAAVQMAEEHSEFVIGFISGSRVSMKPEFLHLTPGVQLEAGGDNLGQQYHSPQEVIGKRGSDIIIVGRGIIASANQLEAAKMYRKAAWEAYLSRLAV

SEQ ID NO: 1096 - protein, 547 aa, Mus musculus
MPSVALKSPRLRRVFVVGVGMTKFMKPGGENSRDYPDMAKEAGQKALEDAQIPYSAVEQACVGYVYGDSTSGQRAIYHSLGLTGIPIINVNNNCSTGSTALFMAHQLIQGGLANCVLALGFEKMERGSIGTKFSDRTTPTDKHIEVLIDKYGLSAHPITPQMFGYAGKEHMEKYGTKVEHFAKIGWKNHKHSVNNTYSQFQDEYSLEEVMKSKPVFDFLTILQCCPTSDGAAAAILSSEEFVQQYGLQSKAVEIVAQEMMTDLPSTFEEKSIIKVVGYDMSKEAARRCYEKSGLTPNDVDVIELHDCFSVNELITYEALGLCPEGQGGTLVDRGDNTYGGKWVINPSGGLISKGHPLGATGLAQCAELCWQLRGEAGKRQVPGAKVALQHNLGLGGAVVVTLYRMGFPEAASSFRTHQVSAAPTSSAGDGFKANLVFKEIEKKLEEEGEQFVKKIGGIFAFKVKDGPGGKEATWVVDVKNGKGSVLPNSDKKADCTITMADSDLLALMTGKMNPQSAFFQGKLKIAGNMGLAMKLQNLQLQPGKAKL

SEQ ID NO: 1097 - protein, 727 aa, Enterococcus hirae
MATNTKMETFVITGMTCANCSARIEKELNEQPGVMSATVNLATEKASVKYTDTTTERLIKSVENIGYGAILYDEAHKQKIAEEKQTYLRKMKFDLIFSAILTLPLMLAMIAMMLGSHGPIVSFFHLSLVQLLFALPVQFYVGWRFYKGAYHALKTKAPNMDVLVAIGTSAAFALSIYNGFFPSHSHDLYFESSSMIITLILLGKYLEHTAKSKTGDAIKQMMSLQTKTAQVLRDGKEETIAIDEVMIDDILVIRPGEQVPTDGRIIAGTSALDESMLTGESVPVEKKEKDMVFGGTINTNGLIQIQVSQIGKDTVLAQIIQMVEDAQGSKAPIQQIADKISGIFVPIVLFLALVTLLVTGWLTKDWQLALLHSVSVLVIACPCALGLATPTAIMVGTGVGAHNGILIKGGEALEGAAHLNSIILDKTGTITQGRPEVTDVIGPKEIISLFYSLEHASEHPLGKAIVAYGAKVGAKTQPITDFVAHPGAGISGTINGVHYFAGTRKRLAEMNLSFDEFQEQALELEQAGKTVMFLANEEQVLGMIAVADQIKEDAKQAIEQLQQKGVDVFMVTGDNQRAAQAIGKQVGIDSDHIFAEVLPEEKANYVEKLQKAGKKVGMVGDGINDAPALRLADVGIAMGSGTDIAMETADVTLMNSHLTSINQMISLSAATLKKIKQNLFWAFIYNTIGIPFAAFGFLNPIIAGGAMAFSSISVLLNSLSLNRKTIK

SEQ ID NO: 1098 - protein, 649 aa, Saccharomyces cerevisiae
MFSVTRRRAAGAAAAMATATGTLYWMTSQGDRPLVHNDPSYMVQFPTAAPPQVSRRDLLDRLAKTHQFDVLIIGGGATGTGCALDAATRGLNVALVEKGDFASGTSSKSTKMIHGGVRYLEKAFWEFSKAQLDLVIEALNERKHLINTAPHLCTVLPILIPIYSTWQVPYIYMGCKFYDFFAGSQNLKKSYLLSKSATVEKAPMLTTDNLKASLVYHDGSFNDSRLNATLAITAVENGATVLNYVEVQKLIKDPTSGKVIGAEARDVETNELVRINAKCVVNATGPYSDAILQMDRNPSGLPDSPLNDNSKIKSTFNQIAVMDPKMVIPSIGVHIVLPSFYCPKDMGLLDVRTSDGRVMFFLPWQGKVLAGTTDIPLKQVPENPMPTEADIQDILKELQHYIEFPVKREDVLSAWAGVRPLVRDPRTIPADGKKGSATQGVVRSHFLFTSDNGLITIAGGKWTTYRQMAEETVDKVVEVGGFHNLKPCHTRDIKLAGAEEWTQNYVALLAQNYHLSSKMSNYLVQNYGTRSSIICEFFKESMENKLPLSLADKENNVIYSSEENNLVNFDTFRYPFTIGELKYSMQYEYCRTPLDFLLRRTRFAFLDAKEALNAVHATVKVMGDEFNWSEKKRQWELEKTVNFIKTFGV

SEQ ID NO: 1099 - protein, 112 aa, Rattus norvegicus
LRLSHEALKQICLSGLHSWKKKFIRFKNGIITGVFPANPSSWLIVVVGVISSMHAKVDPSLGMIAKISRTLDTTGRMSSQTKNIVSGVLFGTGLWVAVIMTMRYSLKVLLSY

SEQ ID NO: 1100 - protein, 200 aa, Rattus norvegicus
HEALKQICLSGLHSWKKKFIRFKNGIITGVFPANPSSWLIVVVGVISSMHAKVDPSLGMIAKISRTLDTTGRMSSQTKNIVSGVLFGTGLWVAVIMTMRYSLKVLLSYHGWMFAEHGKMSRSTKIWMAMVKVLSGRKPMLYSFQTSLPRLPVPAVKDTVSRYLESVRPLMKEEDFQRMTALAQDFAVNLGPKLQWYLKLK

SEQ ID NO: 1101 - protein, 367 aa, Mus musculus
MSGTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 1102 - protein, 368 aa, Drosophila melanogaster
MSTILEKISAIESEMARTQKNKATSAHLGLLKAKLAKLRRELISPKGGGGGTGEAGFEVAKTGDARVGFVGFPSVGKSTLLSNLAGVYSEVAAYEFTTLTTVPGCIKYKGAKIQLLDLPGIIEGAKDGKGRGRQVIAVARTCNLIFMVLDCLKPLGHKKLLEHELEGFGIRLNKKPPNIYYKRKDKGGINLNSMVPQSELDTDLVKTILSEYKIHNADITLRYDATSDDLIDVIEGNRIYIPCIYLLNKIDQISIEELDVIYKIPHCVPISAHHHWNFDDLLELMWEYLRLQRIYTKPKGQLPDYNSPVVLHNERTSIEDFCNKLHRSIAKEFKYALVWGSSVKHQPQKVGIEHVLNDEDVVQIVKKV

SEQ ID NO: 1103 - protein, 286 aa, Saccharomyces cerevisiae
MTYTLAILGCGVMGQALLSAIYNAPKAADETAAAFYPSKIITCNHDEPSAQQVTDLVETFDESPNGIKVESTYGHNVSAVEEASVVLLGTKPFLAEEVLNGVKSVIGGKLLISLAAGWTIDQLSQYTSTVCRVMTNTPAKYGYGCAVVSYSADVSKEQKPLVNELISQVGKYVELPEKNMDAATALVGSGPAFVLLMLESLMESGLKLGIPLQESKECAMKVLEGTVKMVEKSGAHPSVLKHQVCTPGGTTIAGLCVMEEKGVKSGIINGVEEAARVASQLGQKKK

SEQ ID NO: 1104 - protein, 1089 aa, Saccharomyces cerevisiae
MSALPEEVNRTLLQIVQAFASPDNQIRSVAEKALSEEWITENNIEYLLTFLAEQAAFSQDTTVAALSAVLFRKLALKAPPSSKLMIMSKNITHIRKEVLAQIRSSLLKGFLSERADSIRHKLSDAIAECVQDDLPAWPELLQALIESLKSGNPNFRESSFRILTTVPYLITAVDINSILPIFQSGFTDASDNVKIAAVTAFVGYFKQLPKSEWSKLGILLPSLLNSLPRFLDDGKDDALASVFESLIELVELAPKLFKDMFDQIIQFTDMVIKNKDLEPPARTTALELLTVFSENAPQMCKSNQNYGQTLVMVTLIMMTEVSIDDDDAAEWIESDDTDDEEEVTYDHARQALDRVALKLGGEYLAAPLFQYLQQMITSTEWRERFAAMMALSSAAEGCADVLIGEIPKILDMVIPLINDPHPRVQYGCCNVLGQISTDFSPFIQRTAHDRILPALISKLTSECTSRVQTHAAAALVNFSEFASKDILEPYLDSLLTNLLVLLQSNKLYVQEQALTTIAFIAEAAKNKFIKYYDTLMPLLLNVLKVNNKDNSVLKGKCMECATLIGFAVGKEKFHEHSQELISILVALQNSDIDEDDALRSYLEQSWSRICRILGDDFVPLLPIVIPPLLITAKATQDVGLIEEEEAANFQQYPDWDVVQVQGKHIAIHTSVLDDKVSAMELLQSYATLLRGQFAVYVKEVMEEIALPSLDFYLHDGVRAAGATLIPILLSCLLAATGTQNEELVLLWHKASSKLIGGLMSEPMPEITQVYHNSLVNGIKVMGDNCLSEDQLAAFTKGVSANLTDTYERMQDRHGDGDEYNENIDEEEDFTDEDLLDEINKSIAAVLKTTNGHYLKNLENIWPMINTFLLDNEPILVIFALVVIGDLIQYGGEQTASMKNAFIPKVTECLISPDARIRQAASYIIGVCAQYAPSTYADVCIPTLDTLVQIVDFPGSKLEENRSSTENASAAIAKILYAYNSNIPNVDTYTANWFKTLPTITDKEAASFNYQFLSQLIENNSPIVCAQSNISAVVDSVIQALNERSLTEREGQTVISSVKKLLGFLPSSDAMAIFNRYPADIMEKVHKWFA

SEQ ID NO: 1105 - protein, 470 aa, Bacillus subtilis
MSDGKKHVVIIGGGITGLAAAFYMEKEIKEKNLPLELTLVEASPRVGGKIQTVKKDGYIIERGPDSFLERKKSAPQLVKDLGLEHLLVNNATGQSYVLVNRTLHPMPKGAVMGIPTKIAPFVSTGLFSLSGKARAAMDFILPASKTKDDQSLGEFFRRRVGDEVVENLIEPLLSGIYAGDIDKLSLMSTFPQFYQTEQKHRSLILGMKKTRPQGSGQQLTAKKQGQFQTLSTGLQTLVEEIEKQLKLTKVYKGTKVTKLSHSGSCYSLELDNGVTLDADSVIVTAPHKAAAGMLSELPAISHLKNMHSTSVANVALGFPEGSVQMEHEGTGFVISRNSDFAITACTWTNKKWPHAAPEGKTLLRAYVGKAGDESIVDLSDNDIINIVLEDLKKVMNINGEPEMTCVTRWHESMPQYHVGHKQRIKELREALASAYPGVYMTGASFEGVGIPDCIDQGKAAVSDALTYLFS

SEQ ID NO: 1106 - protein, 343 aa, Saccharomyces cerevisiae
MVKVAILGASGGVGQPLSLLLKLSPYVSELALYDIRAAEGIGKDLSHINTNSSCVGYDKDSIENTLSNAQVVLIPAGVPRKPGLTRDDLFKMNAGIVKSLVTAVGKFAPNARILVISNPVNSLVPIAVETLKKMGKFKPGNVMGVTNLDLVRAETFLVDYLMLKNPKIGQEQDKTTMHRKVTVIGGHSGETIIPIITDKSLVFQLDKQYEHFIHRVQFGGDEIVKAKQGAGSATLSMAFAGAKFAEEVLRSFHNEKPETESLSAFVYLPGLKNGKKAQQLVGDNSIEYFSLPIVLRNGSVVSIDTSVLEKLSPREEQLVNTAVKELRKNIEKGKSFILDSSKL

SEQ ID NO: 1107 - protein, 187 aa, Saccharomyces cerevisiae
MQVSPAIVKGIAVSSLGLYAGILTSSTVISITTPINVLTQHLKNVLCTLGCWSTVLGGLATGAFGLSYYLAAPGERPNYLLCGLGVAPLSAAYLYLVSLFNHKLAPKCTRDQNDLEKQKDEKLPQHHPEVKDGEAACPFSKMNNAKTLKPESERSVKCHSYMSLHMSIVTGITIFTFGKCILDGFKA

SEQ ID NO: 1108 - protein, 945 aa, Saccharomyces cerevisiae
MSLTTAAPLLALLRENQDSVKTYALESINNVVDQLWSEISNELPDIEALYDDDTFSDREMAALIASKVYYNLGEYESAVKYALAAKDRFDIDEKSQFVETIVSKSIEMYVQEASKQYTKDEQFYTKDIIDPKLTSIFERMIEKCLKASELKLALGIALEGYRLDIIESALKSKLDQDSTSENVKIINYLLTLAITTVTNSKFRSSILRKSFDFLMNMPNCDYLTLNKVVVNLNDAGLALQLFKKLKEENDEGLSAQIAFDLVSSASQQLLEILVTELTAQGYDPALLNILSGLPTCDYYNTFLLNNKNIDIGLLNKSKSSLDGKFSLFHTAVSVANGFMHAGTTDNSFIKANLPWLGKAQNWAKFTATASLGVIHKGNLLEGKKVMAPYLPGSRASSRFIKGGSLYGLGLIYAGFGRDTTDYLKNIIVENSGTSGDEDVDVLLHGASLGIGLAAMGSANIEVYEALKEVLYNDSATSGEAAALGMGLCMLGTGKPEAIHDMFTYSQETQHGNITRGLAVGLALINYGRQELADDLITKMLASDESLLRYGGAFTIALAYAGTGNNSAVKRLLHVAVSDSNDDVRRAAVIALGFVLLRDYTTVPRIVQLLSKSHNAHVRCGTAFALGIACAGKGLQSAIDVLDPLTKDPVDFVRQAAMIALSMILIQQTEKLNPQVADINKNFLSVITNKHQEGLAKFGACVAQGIMNAGGRNVTIQLENADTGTLDTKSVVGLVMFSQFWYWFPLAHFLSLSFTPTTVIGIRGSDQAIPKFQMNCYAKEDAFSYPRMYEEASGKEVEKVATAVLSTTARAKARAKKTKKEKGPNEEEKKKEHEEKEKERETNKKGIKETKENDEEFYKNKYSSKPYKVDNMTRILPQQSRYISFIKDDRFVPVRKFKGNNGVVVLRDREPKEPVALIETVRQMKDVNAPLPTPFKVDDNVDFPSA

SEQ ID NO: 1109 - protein, 292 aa, Saccharomyces cerevisiae
MNTANTLDGKFVTEGSWRPDLFKGKVAFVTGGAGTICRVQTEALVLLGCKAAIVGRDQERTEQAAKGISQLAKDKDAVLAIANVDVRNFEQVENAVKKTVEKFGKIDFVIAGAAGNFVCDFANLSPNAFKSVVDIDLLGSFNTAKACLKELKKSKGSILFVSATFHYYGVPFQGHVGAAKAGIDALAKNLAVELGPLGIRSNCIAPGAIDNTEGLKRLAGKKYKEKALAKIPLQRLGSTRDIAESTVYIFSPAASYVTGTVLVVDGGMWHLGTYFGHELYPEALIKSMTSKL

SEQ ID NO: 1110 - protein, 61 aa, Saccharomyces cerevisiae
LKIFSYSLATKLCTVLGCLLVILGQYTRTIAMHTAGHSFSHIVKTKKESDHVLVKTGVYSW

SEQ ID NO: 1111 - protein, 75 aa, Saccharomyces cerevisiae
AILECLVESFLFPDLKIFSYSLATKLCTVLGCLLVILGQYTRTIAMHTAGHSFSHIVKTKKESDHVLVKTGVYSW

SEQ ID NO: 1112 - protein, 470 aa, Saccharomyces cerevisiae
MSLSPVVVIGTGLAGLAAANELVNKYNIPVTILEKASSIGGNSIKASSGINGACTETQRHFHIEDSPRLFEDDTIKSAKGKGVQELMAKLANDSPLAIEWLKNEFDLKLDLLAQLGGHSVARTHRSSGKLPPGFEIVSALSNNLKKLAETKPELVKINLDSKVVDIHEKDGSISAVVYEDKNGEKHMVSANDVVFCSGGFGFSKEMLKEYAPELVNLPTTNGQQTTGDGQRLLQKLGADLIDMDQIQVHPTGFIDPNDRSSSWKFLAAESLRGLGGILLNPITGRRFVNELTTRDVVTAAIQKVCPQEDNRALLVMGEKMYTDLKNNLDFYMFKKLVQKLTLSQVVSEYNLPITVAQLCEELQTYSSFTTKADPLGRTVILNEFGSDVTPETVVFIGEVTPVVHFTMGGARINVKAQVIGKNDERLLKGLYAAGEVSGGVHGANRLGGSSLLECVVFGRTAAESIANDRK

SEQ ID NO: 1113 - protein, 73 aa, Xenopus laevis
TGVFYTLMSCEMLSIKNGMRIALNDHMKQRREVAKTVFCLVVIFALCWLPLHVSSIFVRLSATVKRACILKNK

SEQ ID NO: 1114 - protein, 127 aa, Xenopus laevis
VAKTVFCLVVIFALCWLPLHVSSIFVRLSATVKRACILKNKRSCIMAEIQTGVNYQLLMVMNYTGINMASLNSCIGPVALYFVSRKFKNCFQSCLCCWCHRPTLTITPMDEKGSGGKWKANGHDLDL

SEQ ID NO: 1115 - protein, 490 aa, Macaca fascicularis
MDPFVVLVLCLSFVLLFSLWRQSSGRRKLPPGPTPLPIIGNILQIDVKDICKSFSNFSKVYGPVFTVYFGMNPVVVLHGYETVKEALIDNAEEFSGRGILPISERITNGLGIISSNGKRWKETRRFSLTTLRNFGMGKRSIEDRVQEEARCLVEELRKTKASPCDPTFILGCAPCNVICSVVFQKRFDYKDENFLTLIKRFTVNFRILTSPWIQVCNNFPLLIDCFPGTHNKLLKNVALTKSYIREKVKEHQATLDVNNPRDFIDCFLIKMEQEKDNQQSEFTIENLVGTVADLFVAGTETTSTTLRYGLLLLLKHPEVTAKVQEEIDHVIGRHRSPCMQDRSHMPYTDAVIHEIQRYIDLVPTGVPHAVTTDIKFRNYLIPKGTIIITLLTSVLHDDKEFPNPKIFDPGHFLDENGNFKKSDYFMPFSAGKRICAGEGLARMELFLFLTTILQNFNLKSVADLKNLNTTSATRGIISLPPSYQICFIPV

SEQ ID NO: 1116 - protein, 395 aa, Saccharomyces cerevisiae
MSLEREEPQHFGAGPAQMPTPVLQQAAKDLINFNDIGLGIGEISHRSKDATKVIEDSKKHLIELLNIPDTHEVFYLQGGGTTGFSSVATNLAAAYVGKHGKIAPAGYLVTGSWSQKSFEEAKRLHVPAEVIFNAKDYNNGKFGKIPDESLWEDKIKGKAFSYVYLCENETVHGVEWPELPKCLVNDPNIEIVADLSSDILSRKIDVSQYGVIMAGAQKNIGLAGLTLYIIKKSILKNISGASDETLHELGVPITPIAFDYPTVVKNNSAYNTIPIFTLHVMDLVFQHILKKGGVEAQQAENEEKAKILYEALDANSDFYNVPVDPKCRSKMNVVFTLKKDGLDDQFLKEAAARHLTGLKGHRSVGGFRASIYNALSVKAVQNLVDFIKEFAEKNA

SEQ ID NO: 1117 - protein, 303 aa, Saccharomyces cerevisiae
MSVIGRFLYYLRSVLVVLALAGCGFYGVIASILCTLIGKQHLAQWITARCFYHVMKLMLGLDVKVVGEENLAKKPYIMIANHQSTLDIFMLGRIFPPGCTVTAKKSLKYVPFLGWFMALSGTYFLDRSKRQEAIDTLNKGLENVKKNKRALWVFPEGTRSYTSELTMLPFKKGAFHLAQQGKIPIVPVVVSNTSTLVSPKYGVFNRGCMIVRILKPISTENLTKDKIGEFAEKVRDQMVDTLKEIGYSPAINDTTLPPQAIEYAALQHDKKVNKKIKNEPVPSVSISNDVNTHNEGSSVKKMH

SEQ ID NO: 1118 - protein, 95 aa, Saccharomyces cerevisiae
VLVVLALAGCGFYGVIASILCTLIGKQHLAQWITARCFYHVMKLMLGLDVKVVGEENLAKKPYIMIANHQSTLDIFMLGRIFPPGCTVTAKKSLK

SEQ ID NO: 1119 - protein, 171 aa, Saccharomyces cerevisiae
VIASILCTLIGKQHLAQWITARCFYHVMKLMLGLDVKVVGEENLAKKPYIMIANHQSTLDIFMLGRIFPPGCTVTAKKSLKYVPFLGWFMALSGTYFLDRSKRQEAIDTLNKGLENVKKNKRALWVFPEGTRSYTSELTMLPFKKGAFHLAQQGKIPIVPVVVSNTSTLVS

SEQ ID NO: 1120 - protein, 434 aa, Schistosoma japonicum [sequence omitted]

SEQ ID NO: 1121 - protein, 98 aa, Entamoeba histolytica
MKAIVFVLIFAVAFAVTATHQGEILCNLCTGLINTLENLLTTKGADKVKDYISSLCNKASGFIATLCTKVLDFGIDKLIQLIEDKVDANAICAKIHAC

SEQ ID NO: 1122 - protein, 591 aa, Populus trichocarpa
MESTLKEMRDGASVLDMDPKSTVGGGVEDVYGEDRATEDQLVTPWTISVASGYTLLRDPHHNKGLAFTEKERDAHYLRGLLPPTTISQQLQEKKLMNTIRQYQLPLQKYTAMMELEERNERLFYKLLIDNVEELLPVVYTPTVGEACQKYGSIFKRPQGLYISLKEKGKVLDVLKNWPQKSIQVIVVTDGERILGLGDLGCQGIGIPVGKLSLYTALGGVRPSACLPVTIDVGTNNEQLLKDEFYIGLRQRRATGQEYSELLHEFMTAVKQNYGEKVLIQFEDFANHNAFDLLAKYGTTHLVFNDDIQGTAAVVLAGLISALKLLGGSLADHTFLFLGAGEAGTGIAELIALEMSRRSKTPLEETRKKIWLTDSKGLIVSSRKESLQHFKKPWAHEHEPVKGLLEVVKAIKPIVLIGTSGVGKTFTKEVIEAMASFNEKPLILALSNPTSQSECTAQEAYTWTKGKAIFASGSPFDPVEYEGKVFVPGQSNNAYIFPGLGLGLVISGAIRVHDDMLLAAAEALAGQIKEEYLAKGLIYPPLSNIRKISVQIAANVAAKAYELGLATRLPRPENLVKHAESCMYSPAYRYYR

SEQ ID NO: 1123 - protein, 357 aa, Saccharomyces cerevisiae
MGDHNLPDFQTCLKFSVTAKKSFLCMYRDSVSKEKLASSMPSTCDIQLKRAINDAYPGGGIKVTVLNSTTASLDSLATTHVKEFEIVIIPDINSLLQPDQAKLVKIMRDCTVAIEKAQSTRIFIGVVHWNNPVQPSGAAKDGDEAGKPAPKTRIFLPTSFRMGAWLKHKFWFACAPPYLDFESSTESSINTRANNSIGMAEEEKQEPESKRSIILNEEANLNDVFVGSTVRRYILDIMVHLRTHRLTYNAKAGGVYTNSLDDVVLLSRLIGLHSGKMFVSPSHVKEASRWYFPMHLELVQRSSMDSSLLYGSDPNLVDEMLEKLAKIKCEEVNEFENPLFLESLVVKNVLSKVVPPV

SEQ ID NO: 1124 - protein, 448 aa, Caenorhabditis elegans
MLRAVSTSFGTARAASAVAKKNMPNIVLVDAVRTPFVVSGTVFKDLMAVDLQKEAIKALVEKTKLPYEQLDHIICGTVIQECKTSNIAREAALLAGVPDKIPAHTVTLACISSNVAMTTGMGMLATGNANAIIAGGVELLSDVPIRYNRNARKAMLGMNKAKDVPSKLKIGGQIVKNLLSPELPAVAEFSTGETMGHSGDRLAAAFNVSRREQDEFAIRSHTLASEAAKNGKFTDVVPVFLDGKKPKTIKEDNGIRVSTLEKLSSLKPAFVKPHGTVTAANASYLTDGASAALIMTEEYALANGYKPKAYLRDYLYVAQDPKDQLLLSPAYVIPKLLDKAGLTLKDVDVFEIHEAFAGQVLANLNAMDSDYFCKEQMKRSGKFGRVPMDKLNLWGGSLSIGHPFGATGVRLATHSAHRLKEEKGQYAVIAACAAGGHGVGMLIEAYGK

SEQ ID NO: 1125 - protein, 140 aa, Caenorhabditis elegans
TASSHPAKVKMMTKKEKEYLLANVVKKVHKSEKTRSIPYSKILTSPAFLGQLQCHFFVNLFMTLFQIYLPSYFKEVLHLGVIANGTFTAIPNIFNMIFKVVWGIGIDKLKENKILSNTKAVKVSHGVASFGSSFSLILLA

SEQ ID NO: 1126 - protein, 138 aa, Caenorhabditis elegans
LANVVKKVHKSEKTRSIPYSKILTSPAFLGQLQCHFFVNLFMTLFQIYLPSYFKEVLHLGVIANGTFTAIPNIFNMIFKVVWGIGIDKLKENKILSNTKAVKVSHGVASFGSSFSLILLAFFVDCSNPTTGLIFFCLM

SEQ ID NO: 1127 - protein, 344 aa, Caenorhabditis elegans
MKKHTHHKVFNYFVEPQTALKPCNIIQAYGDSTGKEPLIDLQSIKLWLNSFGNQGHSSEAVLNVLFTLGVILFVIYQVASLLHRMNKRVEKQLESRTKQRKVEVADKHVGDEMVFTDLHENVIRERMIPYRMPVINDDITLRNSQIFYEEMKMRRSCRQFSSRDVPLKVIQNLLKTAGTSPSVGNLQPWTFCVVSSDSIKTMIRKILEADERDNYVSRKKGASWVVDVSQLQDTWRRPYITDAPYLLIVCHEIFRDVHSKTERVFHYNQISTSIAVGILLAAIQNVGLSTVVTSPLNAGPDISRILRRPENESILLLLPLGYASEDVLVPDLKRKPVEHITKLY

SEQ ID NO: 1128 - protein, 366 aa, Caenorhabditis elegans
MGILEKIAEIEHEISRTQKNKATEYHLGLLKAKLAKYRQQLLEPTGKGGAKGEGFDVMKSGDARVAMVGFPSVGKSTLLSSMTSTHSEAAGYEFTTLTCIPGVISYNGANIQLLDLPGIIEGASQGKGRGRQVISVAKTADLILMMLDAGKSDQQKMLLERELEAVGIRLNKKPPNIYVKQKKVGGVKFTNTVPLTHCNEKLIMTVLHEYKIFNADVIFREDCTVDEFIDVIQGNRVYMTCLYVYNKVDQISIEEIDRLARMPHHVVISCEMNLNMDYLLEKMWEYLALVRVYTKKPGNAPDLGPEDGIILRGGATIEHCCHALHRSIAAQLRYAIVWGTSTKFSPQRVGLHHKLDHEDVIQIVKK

SEQ ID NO: 1129 - protein, 507 aa, Caenorhabditis elegans
MYLPIFCIFLSVVDSLRILQIVPGFTNSHVLFNYRLAETLRFLGHDVKMWTQMEMAMLDTGNNKLPEGVSEYRIPIHFTDTLKTEGLKVFQSMMFESGDAHDLWWTGQEFKDMRVEACEQMLRHDESVYEDFRKDGFDVAIAHFHDLCPLAIAKKMNVKRVIWITHGTSIYEFSAVQLGLRTIPSTIPHPLSSAGFSQLFLDRVQNTLWHLSLLDFVNLPQNLLVDENLFYREFVGADQDDLWDLAKTTVPSLLINGDRMLDFPRPLPIHIAFSGELGVSKGKKLVMEKWLEDIIEKPSDGLIVFSLGTVSNTTNMPAQMINSFLGAFGKLKTYTILWRMEKSVAGAEKYENLHLVKWLPQKDIMRHPKMKLMIAHGGYNSFLEAAQAGIPAVLMPLFADQKINAKRAQRYGMATVLDKLDLTINNVYGAIKEALKPEYSTNAKKLSAMLSDQVARKPYSALRYSLKLATSPKPSLFTLKSQHLSFLEFHNLDIFSIVLLTAFIVCF

SEQ ID NO: 1130 - protein, 68 aa, Caenorhabditis elegans
TPCHKSAGPKVPACGAIDCPTNAHQLVDISKVEHLGTKVFHPHFPDFEWLLKICGCLALTVLLVFILK

SEQ ID NO: 1131 - protein, 66 aa, Caenorhabditis elegans
KSAGPKVPACGAIDCPTNAHQLVDISKVEHLGTKVFHPHFPDFEWLLKICGCLALTVLLVFILKYS

SEQ ID NO: 1132 - protein, 200 aa, Caenorhabditis elegans
HVVVITAQCLLDLIRHAYLKIEDMCVLIFDECHHALGSQHPYRSIMVDYKLLKKDKPVPRVLGLTASLIKAKVAPEKLMEQLKKLESAMDSVIETASDLVSLSKYGAKPYEVVIICKDFEIGCLGIPNFDTVIEIFDETVAFVNTTTEFHPDLDLDPRRPIKDSLKTTRAVFRQLGPWAAWRTAQVWEKELGKIIKSQVL

SEQ ID NO: 1133 - protein, 132 aa, Caenorhabditis elegans
LLDKATKKNTIVQLGTGSGKTFIAVLLLKEYGVQLFAPLDQGGKRAFFVVEKVNLVEQQAIHIEVHTSFKVGQVHGQTSSGLWDSKEQCDQFMKRHHVVVITAQCLLDLIRHAYLKIEDMCVLIFDECHHAL

SEQ ID NO: 1134 - protein, 468 aa, Caenorhabditis elegans
MSLSGMAIRRLITKGVIPVCQVAPLSTSAEGSTNLKEVLSKKIPAHNAKVKSFRTEHGSTVVQNVNIDMIYGGMRSMKGMVTETSVLDPEEGIRFRGYSIPECQKLLPKAKGGEEPLPEAIWWLLCTGDVPSEAQTAAITKEWNARADLPTHVVRMLDNFPDNLHPMAQFIAAIAALNNESKFAGAYARGVAKASYWEYAYEDSMDLLAKLPTVAAIIYRNLYRDGSAVSVIDPKKDWSANFSSMLGYDDPLFAELMRLYLVIHSDHEGGNVSAHTSHLVGSALSDPYLSFSAAMAGLAGPLHGLANQEVLVFLNKIVGEIGFNYTEEQLKEWVWKHLKSGQVVPGYGHAVLRKTDPRYECQREFALKHLPNDDLFKLVSTLYKITPGILLEQGKAKNPWPNVDSHSGVLLQYFGMTEMSFYTVLFGVSRALGCLSQLIWARGMGLPLERPKSHSTDGLIKLALAAKK

SEQ ID NO: 1135 - protein, 491 aa, Caenorhabditis elegans
MTQVLVRNGIQAVGDGLTSLIIVGKKSVLKNVTFEGKFKEVAQKFVTDGDSWNSMISRIPASGRHPLHYELAHLITVPDASSRGNTPTNAHSIYKELKPINYPEDTKNVHFVLFAEYPDVLSHVAAIARTFCKFSMKTSGIRELNVNIDVVCDKLTNEDAVFLTDLSESVRETARLIDTPANILTTDALVDEAVKVGNATGSKITVIRGEELLKAGFGGIYHVGKAGPTPPAFVVLSHEVPGSTEHIALVGKGVVYDTGGLQIKTKTGMPNMKRDMGGAAGMLEAYSALVKHGFSQTLHACLCIVENNVSPIANKPDDIIKMLSGKTVEINNTDAEGRLILADGVFYAKETLKATTIFDMATLTGAQAWLSGRLHGAAMTNDEQLENEIIKAGKASGDLVAPMLFAPDLFFGDLKSSIADMKNSNLGKMDGPPSAVAGLFIGAHIGFGEGLRWLHLDIAAPAEVGDRGTGYGPALFSTLLGKYTSVPMLKQ

SEQ ID NO: 1136 - protein, 416 aa, Bos taurus
MALSITRGLLLLAALCCLAPISLAGVLQGHAVQETDDTSHQEAACHKIAPNLANFAFSIYHHLAHQSNTSNIFFSPVSIASAFAMLSLGAKGNTHTEILKGLGFNLTELAEAEIHKGFQHLLHTLNQPNHQLQLTTGNGLFINESAKLVDTFLEDVKNLYHSEAFSINFRDAEEAKKKINDYVEKGSHGKIVELVKVLDPNTVFALVNYISFKGKWEKPFEMKHTTERDFHVDEQTTVKVPMMNRLGMFDLHYCDKLASWVLLLDYVGNVTACFILPDLGKLQQLEDKLNNELLAKFLEKKYASSANLHLPKLSISETYDLKSVLGDVGITEVFSDRADLSGITKEQPLKVSKALHKAALTIDEKGTEAVGSTFLEAIPMSLPPDVEFNRPFLCILYDRNTKSPLFVGKVVNPTQA

SEQ ID NO: 1137 - protein, 150 aa, Rattus norvegicus
ELAQVLKVANSDTHINNVFMYVVTSLLGLIPMTGILMSYSQIASSLLKMSSSVSKYKAFSTCGSHLCVVSLFYGSATIVYFCSSVLHSTHKKMIASLMYTVISPMLNPFIYSLRNKDVKGALGKLFIRVASCPLWSKDFRPKFILKPERQ

SEQ ID NO: 1138 - protein, 137 aa, Rattus norvegicus
LKVANSDTHINNVFMYVVTSLLGLIPMTGILMSYSQIASSLLKMSSSVSKYKAFSTCGSHLCVVSLFYGSATIVYFCSSVLHSTHKKMIASLMYTVISPMLNPFIYSLRNKDVKGALGKLFIRVASCPLWSKDFRPK

SEQ ID NO: 1139 - protein, 52 aa, Gallus gallus
KTDWIFGDVMCKLQRFIFHVNLYGSILFLTCISVHRYTGVVHPLKSLGRLKK

SEQ ID NO: 1140 - protein, 94 aa, Gallus gallus
KTDWIFGDVMCKLQRFIFHVNLYGSILFLTCISVHRYTGVVHPLKSLGRLKKKNAVYVSSLVWALVVAVIAPILFYSGTGVRRNKTITCYDTTA

SEQ ID NO: 1141 - protein, 485 aa, Catharanthus roseus
MALLVEKTSSGREYKVKDMSQADFGRLEIELAEVEMPGLMSCRAEFGPSQPFKGAKITGSLHMTIQTAVLIETLTALGAEVRWCSCNIFSTQEHAAAAIARDSAAVFAWKGETLQEYWWCTERALDWGPDGGPDLIVDDGGDATLLIHEGVKAEEEYKKNGALPDPSSTDNAEFQIVLTIIRDGLKSDPTKYTRMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQATMEGLQVLTLEDVVSEADIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNERKTGKYEKKVYVLPKHLDEKVAALHLGKLGAKLTKLTKDQADYISVPIEGPYKPAHYRY

SEQ ID NO: 1142 - protein, 59 aa, Rhodopseudomonas palustris
MNQGRIWTVVKPTVGLPLLLGSVAIMVFLVHFAVLTHTTWVAKFMNGKAAAIESSIKAV

SEQ ID NO: 1143 - protein, 156 aa, Saccharomyces cerevisiae
MTQLKYLLLVSRQGKIRLKKWYTAMSAGEKAKIVKDLTPTILARKPKMCNIIEYNDHKVVYKRYASLYFIVGMTPDVDNELLTLEIIHRFVETMDTYFGNVCELDIIFNFSKVYDILNEMIMCDGSIAESSRKEVLHHVTVMDTMESNDNLERVLS

SEQ ID NO: 1144 - protein, 1027 aa, Artemia franciscana
MEDAHAKKWEEVVDYFGVDPERGLALEQVKKNQEKYGPNELPAEEGKSLLTLILEQFDDLLVKILLLAAIISLVLALFEEHDDEAEQLTAYVEPFVILLILIANAVVGVWQEKNAESAIEALKEYEPEMGKVIRADKTGIQKIKARDLVPGDIVEISVGDKIPADLRLISILSTTLRIDQSILTGESVSVIKHTDPVPDPRAVNQDKKNMLFSGTNVSAGKARGVVMGTGLNTAIGSIRTQMFETEEMKTPLQQKLDEFGEQLSKVISVICVAVWAINIGHFNDPAHGGSWIKGAIYYFKIAVALAVAAIPEGLPAVITTCLALGTRRMAKKNAIVRSLPSVETLGCTSVICSDKTGTLTTNQMSVSRMFVFKDIPDDAAPELYQFELTGSTYEPIGETFMQGQKINAADYDAVKEITTICMMCNDSAIDFNEYKQAFEKVGEATETALIVLGEKLNPYNLSKAGKDRRSAALVVREDMDTRWKKEFTLEFSRDRKSMSSYCVPLKAGLLSNGPKMFVKGAPEGVLDRCTHVRVGTKKVPMTPAIMDKILEVTRAYGTGRDTLRCLALATIDDPMDPKDMDIIDSTKFVKYEQNCTFVGVVGMLDPPRKEVLDAIERCRAAGIRVIVITGDNKATAEAICRRIGVFGEDENTEGMAYTGREFDDLSVEGQRDAVARSRLFARVEPFHKSKIVEYLQGMGEISAMTGDGVNDAPALKKAEIGIAMGSGTAVAKSAAEMVLADDNFSTIVAAVEEGRAIYNNMKQFIRYLISSNIGEVVSIFLTAALGLPEALIPVQLLWVNLVTDGLPATALGFNPPDLDIMNKPPRRADEGLITGWLFFRYMAIGTYVGAATVGAAAHWFMMSPTGPGLNFYQLSHHLQCTPENEYFEGIDCEIFSDPHPMTMALSVLVTIEMLNAINSLSENQSLLVMPPWSNIWLISAICLSMTLHFVILYVEILSTVFQICPLTLTEWIVVLKISFPVLLLDEVLKFVARKYTDGMPLSSYFVDAWGLVLAWALFFGVIFYSPL

SEQ ID NO: 1145 - protein, 1031 aa, Hydra vulgaris
MADPGDLESRGKADSYSVAEKKSAPKKISKKNANKAKLEDLKKELEMTEHSMKLESLLSMYETSLEKGLSENIVARNLERDGLNALTPPKQTPEWVKFCKQMFGGFSMLLWIGAILCFFAFGIRAVRDTNPNMDELYLGIVLSVVVIITGCFSYYQESKSSKIMESFKKMIPQEALVLRDGKKITINAEQCVVGDVVFVKFGDRIPADIRIVECKGLKVDNSSLTGESEPQSRAVDFTHENPIETKNLAFFSTNAVEGTATGIVVRIGDNTVMGRIANLASGLGSGKTPIALEIEHFIHIVTGVAVFLGVSFLIISLAMGYHWLEAIIFLIGIIVANVPEGLLATVTVCLTLTAKKMAKKNCLVKHLEAVETLGSTSVICSDKTGTLTQNRMTVAHMWFDKMIVEADTTEDQSGIAHDKGSLTWKSLAKVAALCSRAEFKPNQNDVAVLRKECTGDASETAILKFVELSVGNVMDIRAKNKKVTEIPFNSTNKYQVSVHEQENSSGYLLVMKGAPEKVLERCSTILINGEEQPLKDDVIEIYNKAYDELGGLGERVLGFCHYYLPVDQYPKGFLFKTEEEQNFPLEGLCFLGLLSMIDPPRAAVPDAVSKCRSAGIKVIMVTGDHPITAKAIAKGVGIISEGNECEEDIALRLNIPLEDLSEDQKKSAKACVIHGAKLKDIKNEELDKILCDHTEIVFARTSPQQKLIIVEGCQRQGAIVAVTGDGVNDSPALKKADIGVAMGIAGSDVSKQAADMILLDDNFASIVTGVEEGRLIFDNLKKSIVYTLTSNIPEISPFLMFILFGIPLPLGTITILCIDLGTDMVPAISLAYEKAESDIMKRHPRNPIRDKLVNERLISLAYGQIGMMQATAGFFTYFIILAENGFLPSYLFGLRSQWDDMSNNNLLDSFGSEWTYFQRKEIELTCQTAFFTTIVVVQWADLIISKTRRLSLFQQGMTNWFLNFGLFFETALAAFLQYTPGVNTGLRLRPMNFTWWLPGLPFSLLIFVYDEIRRYLLRKNPGGWVEKETYY

SEQ ID NO: 1146 - protein, 97 aa, Hydra vulgaris
AVFLGVSFLIISLAMGYHWLEAIIFLIGIIVANVPEGLLATVTVCLTLTAKKMAKKNCLVKHLEAVETLGSTSVICSDKTGTLTQNRMTVAHMWFDK

SEQ ID NO: 1147 - protein, 60 aa, Hydra vulgaris
FLGVSFLIISLAMGYHWLEAIIFLIGIIVANVPEGLLATVTVCLTLTAKKMAKKNCLVKH

SEQ ID NO: 1148 - protein, 521 aa, Escherichia coli
MLDTNMKTQLKAYLEKLTKPVELIATLDDSAKSAEIKELLAEIAELSDKVTFKEDNSLPVRKPSFLITNPGSNQGPRFAGSPLGHEFTSLVLALLWTGGHPSKEAQSLLEQIRHIDGDFEFETYYSLSCHNCPDVVQALNLMSVLNPRIKHTAIDGGTFQNEITDRNVMGVPAVFVNGKEFGQGRMTLTEIVAKIDTGAEKRAAEELNKRDAYDVLIVGSGPAGAAAAIYSARKGIRTGLMGERFGGQILDTVDIENYISVPKTEGQKLAGALKVHVDEYDVDVIDSQSASKLIPAAVEGGLHQIETASGAVLKARSIIVATGAKWRNMNVPGEDQYRTKGVTYCPHCDGPLFKGKRVAVIGGGNSGVEAAIDLAGIVEHVTLLEFAPEMKADQVLQDKLRSLKNVDIILNAQTTEVKGDGSKVVGLEYRDRVSGDIHNIELAGIFVQIGLLPNTNWLEGAVERNRMGEIIIDAKCETNVKGVFAAGDCTTVPYKQIIIATGEGAKASLSAFDYLIRTKTA

SEQ ID NO: 1149 - protein, 84 aa, Mus musculus
AASKVNGWTFGSTLCKIFSYVKEVTFYSSVLLLACISMDRYLAIVHATSTLIQKRHLVKFVCIAMWLLSVILALPILILRNPVK

SEQ ID NO: 1150 - protein, 56 aa, Mus musculus
KVNGWTFGSTLCKIFSYVKEVTFYSSVLLLACISMDRYLAIVHATSTLIQKRHLVK

SEQ ID NO: 1151 - protein, 54 aa, Oryctolagus cuniculus
AASKVHGWTFGTPLCKVVSLVKEVNFYSGILLLACISVDRYLAIVHATRTMIQK

SEQ ID NO: 1152 - protein, 56 aa, Oryctolagus cuniculus
KVHGWTFGTPLCKVVSLVKEVNFYSGILLLACISVDRYLAIVHATRTMIQKRHLVK

SEQ ID NO: 1153 - protein, 418 aa, Rattus norvegicus
MSMFFYLFLLVLGLQATIHCAPHNSSEGKVTTCHLPQQNATLYKMPSINADFAFRLYRKLSVENPDLNIFFSPVSISAALAMLSFGSGSSTQTQILEVLGFNLTDTPVKELQQGFQHLICSLNFPNNELELQMGNAVFIGQQLKPLAKFLDDVKTLYETEVFSTDFSNVSAAQHEINSYVEKQTKGKIVGLIQDLKLNIIMILVNYIHFKAQWANPFRVSKTEESSNFSVDKSTTVQVPMMHQLEQYYHYVDVELNCTVLQMDYSANALALFVLPKEGHMEWVEAAMSSKTLKKWNHLLQKGWVELFVPKFSISATYDLGSTLQKMGMRDAFAESADFPGITKDNGLKLSYAFHKAVLHIGEEGTKEGASPEAGSLDQPEVAPLHAVIRLDRTFLLMILEKRTRSVLFLGKVVDPTKE

SEQ ID NO: 1154 - protein, 171 aa, Mus musculus
AQEKTNLEVIILVGTAVIAMFFWLLLVILVRTVKRANEGELKTGYLSIVMDPDELPLDERCERLPYDASKWEFPRDRLKLGKPLGRGAFGQVIEADAFGIDKTATCKTVAVKMLKEGATHSEHRALMSELKILIHIGHHLNVVNLLGACTKPGGPLMVIVEFSKFGNLSTY

SEQ ID NO: 1155 - protein, 162 aa, Mus musculus
KTNLEVIILVGTAVIAMFFWLLLVILVRTVKRANEGELKTGYLSIVMDPDELPLDERCERLPYDASKWEFPRDRLKLGKPLGRGAFGQVIEADAFGIDKTATCKTVAVKMLKEGATHSEHRALMSELKILIHIGHHLNVVNLLGACTKPGGPLMVIVEFSKF

SEQ ID NO: 1156 - protein, 711 aa, Saccharomyces cerevisiae
MHWTSILSAILLFCLSGARASPAKTVIRNKVPLLVTNACTRIFQKVTWEYTSKSKRSSPVCSYEPAFQSMLYCIYETLDEKGYSNKTLEKTFSTIKKNCASYSDALQNMTNSEFYDVLNNGTRHMTPYVKGSANLTYPVEMDTQLRKAYYHALHGFYANLDVGNIYGGIICAYFVAIMAFAGVLHCMNYTPFKTVLLKQKLVGYVRGYLTLPTIGSKHASDFSYFRIFTGYLPTRLEGIIILGYLVLHTVFLAYGYEYDPENIIFKSRRVQVARYVADRSGVLAFAHFPLIVLFAGRNNFLEYISGVKYTSFIMFHKWLGRMMFLDAMIHGSAYTSYTVANKTWATSKNRLYWQFGVAALCLAGTMVFFSFAVFRKYFYEAFLFLHIVLGAMFFYACWEHVVSLSGIEWIYTAIAIWIVDRIIRIIKASYFGFPKASLQLIGDDLIRLTVKKPARPWRAKPGQYVFVSFLHPLYFWQSHPFTVLDSVSKNGELVIILKEKKGVTRLVKKYVCRNGGKTSMRLAIEGPYGSSSPVNNYNNVLLLTGGTGLPGPIAHAIKLGKTSAAAGKQSVKLVIAVRGFDVLEAYKPELMCLENLNVQLHIYNTMEVPSLTPSDSLDISQQDEKADEKGTVVATTLEKSANPLGFDGVVFHCGRPNVKELLHEAAELSGSLSVVCCGPPIFVDKVRNETAKIVLDKSAKAIEYFEEYQCW

SEQ ID NO: 1157 - protein, 386 aa, Saccharomyces cerevisiae
MVNLNTIPPKNGRDYYIALGLEGSANKLGVGIVKHPLLPKHANSDLSYDCEAEMLSNIRDTYVTPPGEGFLPRDTARHHRNWCIRLIKQALAEADIKSPTLDIDVICFTKGPGMGAPLHSVVIAARTCSLLWDVPLVGVNHCIGHIEMGREITKAQNPVVLYVSGGNTQVIAYSEKRYRIFGETLDIAIGNCLDRFARTLKIPNEPSPGYNIEQLAKKAPHKENLVELPYTVKGMDLSMSGILASIDLLAKDLFKGNKKNKILFDKTTGEQKVTVEDLCYSLQENLFAMLVEITERAMAHVNSNQVLIVGGVGCNVRLQEMMAQMCKDRANGQVHATDNRFCIDNGVMIAQAGLLEYRMGGIVKDFSETVVTQKFRTDEVYAAWRD

SEQ ID NO: 1158 - protein, 325 aa, Pasteurella haemolytica
MRILGIETSCDETGVAIYDEDKGLVANQLYSQIDMHADYGGVVPELASRDHIRKTLPLIQEALKEANLQPSDIDGIAYTAGPGLVGALLVGSTIARSLAYAWNVPALGVHHMEGHLLAPMLEENAPEFPFVALLISGGHTQLVKVDGVGQYELLGESIDDAAGEAFDKTGKLLGLDYPAGVAMSKLAESGTPNRFKFPRPMTDRPGLDFSFSGLKTFAANTIKANLNENGELDEQTKCDIAHAFQQAVVDTILIKCKRALEQTGYKRLVMAGGVSANKQLRADLAEMMKKLKGEVFYPRPQFCTDNGAMIAYTGFLRLKTMNKPT

SEQ ID NO: 1159 - protein, 126 aa, Saccharomyces cerevisiae
MSSAATVDPNEAFGLITKNLQEVLNPQIIKDVLEVQKRHLKLYWGTAPTGRPHCGYFVPMTKLADFLKAGCEVTVLLADLHAFLDNMKAPLEVVNYRAKYYELTIKAILRSINVPIEKLKFVVGSS

SEQ ID NO: 1160 - protein, 117 aa, Saccharomyces cerevisiae
IIKDVLEVQKRHLKLYWGTAPTGRPHCGYFVPMTKLADFLKAGCEVTVLLADLHAFLDNMKAPLEVVNYRAKYYELTIKAILRSINVPIEKLKFVVGSSYQLTPDYTMDIFRLSNIV

SEQ ID NO: 1161 - protein, 647 aa, Flaveria pringlei
MMSLNSSSVVKSSISGVSWTQSQSVRLSVRRPMVVAMVNSNGRPERSVGVSVDGAVKDVNAPVAVEVADSESKKPTAVVGGGVEDVYGEDSATEDHFITPWSVSVASGYSLLRDPHHNKGLAFTEKERDAHYLRGLLPPVVVNHDLQVKKMMHNIRQYEVPLQRYQAMMDLQERNERLFYKLLIENIEELLPIVYTPTVGEACQKYGTIFKNPQGLYISLKDKGKVLEILKNWPQKKIQVIVVTDGERILGLGDLGCQGMGIPVGKLSLYTALGGIRPSACLPITIDVGTNNEKMLNDEFYIGLRQRRASGKEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNAPLEETRKKIWLVDSKGLIVRSRLDSLQHFKKPWAHDHEPVNKFLDAVKAIKPTVLIGSSGAGQTFTKEVVEAMSSFNEKPIILALSNPTSQSECTAEQAYTWSEGRTIFASGSPFAPVEYNGKVYVSGQSNNAYIFPGFGLGLIISGAIRVHDEMLLAASEALAEQVTQEHFDNGLIYPPFTNIRKISAHIAAKVAAKAYELGLASRLPQPENLVAYAESCMYSPKYRNYR

SEQ ID NO: 1162 - protein, 527 aa, Rattus norvegicus
  MOD_RES (521)..(521): Any amino acid
MLKNILLWSLQLSLLGMSLGGNVLIWPMEGSHWLNVKIIIDELLRKEHNVTVLVASGALFITPSVSPSLTFEIYPVPFGKEKIESVIKDFVLTWLENRPSPSTIWTFYKEMAKVIEEFHLVSRGICDGVLKNEKLMTKLQRGKFEVLLSDPVFPCGDIVALKLGIPFIYSLRFSPASTVEKHCGKVPFPPSYVPAILSELTDQMSFADRVRNFISYRMQDYMFETLWKQWDSYYSKALGRPTTLCETMGKAEIWLMRTYWDFEFPRPYLPNFEFVGGLHCKPAKPLPKEMEEFVQTSGEHGVVVFSLGSMVKNLTEEKANLIASALAQIPQKVLWRYKGKIPATLGSNTRLFDWIPQNDLLGHPKTRAFITHGGTNGIYEAIYHGIPMVGVPMFADQPDNIAHMKAKGAAVEVNMNTMTSADLLSAVRAVINEPFYKENAMRLSRIHHDQPVKPLDRAVFWIEFVMRHKGAKHLRVAAHDLSWFQYHSLDVIGFLLACMASAILLVIKCCLFVFQKIGKTXKKNKRD

SEQ ID NO: 1163 - protein, 74 aa, Rattus norvegicus
ISALLLLQISFCFKSGNCGKVLVWPMEYSHWMNIKIILEELVQKGHEVTVLRPSAFVFLDPKETSDLKFVTFPT

SEQ ID NO: 1164 - protein, 531 aa, Oryctolagus cuniculus
MPVKCISVLLLLLQLSCCFSSGSCGKVLVWPMEFSHWMNMKTILDALVQQGHEVTVLRSSASIVIGSNNESGIKFETFHTSYRKDEIENFFMDWFYKMIYNVSIESYWETFSLTKMVILKYSDICEDICKEVILNKKLMTKLQESRFDVVLADPVSPGGELLAELLKIPLVYSLRGFVGYMLQKHGGGLLLPPSYVPVMMSGLGSQMTFMERVQNLLCVLYFDFWFPKFNEKRWDQFYSEVLGRPVTFLELMGKADMWLIRSYWDLEFPRPLLPNFDFIGGLHCKPAKPLPQEMEDFVQSSGEEGVVVFSLGSMISNLTEERANVIASALAQLPQKVLWRFEGKKPDMLGSNTRLYKWIPQNDLLGHPKTKAFITHGGANGVFEAIYHGIPMVGLPLFGDQLDNIVYMKAKGAAVKLNLKTMSSADLLNALKTVINDPSYKENAMTLSRIHHDQPMKPLDRAVFWIEYVMRHKGAKHLRVAAHDLTWYQYHSLDVIGFLLACVAITTYLIVKCCLLVYRYVLGAGKKKKRD

SEQ ID NO: 1165 - protein, 129 aa, Oryctolagus cuniculus
VVVFSLGSMISNLTEERANVIASALAQLPQKVLWRFEGKKPDMLGSNTRLYKWIPQNDLLGHPKTKAFITHGGANGVFEAIYHGIPMVGLPLFGDQLDNIVYMKAKGAAVKLNLKTMSSADLLNALKTV

SEQ ID NO: 1166 - protein, 46 aa, Oryctolagus cuniculus
HDLTWYQYHSLDVIGFLLACVAITTYLIVKCCLLVYRYVLGAGKKK

SEQ ID NO: 1167 - protein, 530 aa, Oryctolagus cuniculus
MSVKHVSVLLLLLQLSCCFRTGSCGKVLVWPMDFSLWMNLNVILDELVRRGHEVIVLRNSASIFIDPSKQANIKFETFPIAATKDDLEDLFVHYVSTWTNARQNSQWKYFSLLQKLFSEYSDSCENACKEVVFNKTLMTKLQESRFDILLSDAIGPCGELLAELLKIPFVYSLRFTPGYTMEKYSGGLSVPPSYVPIILSDLSGKMTFMERVNNMLCMLYFDFWFQMFNKKRWDQFYSEVLGRPVTFSELVGKADMWLIRSYWDLEFPRPTLPNIQFVGGLHCKPAKPLPKEMEEFVQSSGEEGVVVFSLGSMVSNMTEERANLIASAFAQLPQKVIWRFDGQKPETLGPNTRIYDWIPQNDLLGHPKTKAFVTHGGANGIYEAIHHGIPMVGLPLFGEQPDNIAHMTAKGAAIRLNWKTMSSEDLLNALKTVINDPSYKENVMTLSSIHHDQPMKPLDRAVFWIEYVMRHKGAKHLRVAAHDLTWFQYHSLDVVGFLVSCAAFLIFLVIKSYLFVYQKLVKIGKKQKRD

SEQ ID NO: 1168 - protein, 94 aa, Escherichia coli
VIHSWLNRMLLPDTVGTGGDSHTRFPIGISFPAGSGLVAFAAATGVMPLDMPESVLVRFKGKMQPGITLRDLVHAIPLYAIKQGLLTVEKKGKK

SEQ ID NO: 1169 - protein, 116 aa, Escherichia coli
VIHSWLNRMLLPDTVGTGGDSHTRFPIGISFPAGSGLVAFAAATGVMPLDMPESVLVRFKGKMQPGITLRDLVHAIPLYAIKQGLLTVEKKGKKNIFSGRILEIEGLPDLKVEQAF

SEQ ID NO: 1170 - protein, 131 aa, Bacillus subtilis
MKKHGILNSHLAKILADLGHTDKIVIADAGLPVPDGVLKIDLSLKPGLPAFQDTAAVLAEEMAVEKVIAAAEIKASNQENAKFLENLFSEQEIEYLSHEEFKLLTKDAKAVIRTGEFTPYANCILQAGVLF

SEQ ID NO: 1171 - protein, 585 aa, Mesembryanthemum crystallinum
MGGSNALNEMTNGSDGITGGVADVYGEEFATQDQLVTPWSFSVACGHSLLRDPQHNKGLAFTEKERDAHFLRGLLPPVVLSQELQEKKFLTTLRQYQVPLQKYMAMMDLQERNEKLFYKLLVDHVEELLPLVYTPTVGEGCQKYGSIFRRPQGLFISLKDKGRILELLRNWPEKKIQVIVVTDGERILGLGDLGCQGMGIPVGKLSLYSALGGVCPSACLPITLDVGTNNQKLLDDEFYIGLKQKRATGEEYAEFVQEFMSAVKQNYGEKILVQFEDFANHNAFELLEKYRTTHLVFNDDIQGTASVVLAGLIASLKLLGGTLADHKFLFLGAGEAGTGIAELIALEMSKKTKAPVEQMRKKIWLVDSKGLVVSSRKETLQQFKLPWAHEHEPITTLIDAVQAIKPTVLIGTSGKGKQFTKEVVEAMANINAKPLILALSNPTSQSECTAEEAYTWSQGHAIFASGSPFDPVEYEGRTFVPGQANNAYIFPGFGLGLIMCGAIRVHDDMLLAASEALASQVTGEHFIKGLIYPPFKDIRKISAHIAAGVAAKAYELGLASRLPQPADLVKFAESCMYNPTYRSFR

SEQ ID NO: 1172 - protein, 574 aa, Bacillus subtilis
MGTNVQVDSASAECTQTMSGALMLIESLKKEKVEMIFGYPGGAVLPIYDKLYNSGLVHILPRHEQGAIHAAEGYARVSGKPGVVIATSGPGATNLVTGLADAMIDSLPLVVFTGQVATSVIGSDAFQEADILGITMPVTKHSYQVRQPEDLPRIIKEAFHIATTGRPGPVLIDIPKDVATIEGEFSYDHEMNLPGYQPTTEPNYLQIRKLVEAVSSAKKPVILAGAGVLHGKASEELKNYAEQQQIPVAHTLLGLGGFPADHPLFLGMAGMHGTYTANMALHECDLLISIGARFDDRVTGNLKHFARNAKIAHIDIDPAEIGKIMKTQIPVVGDSKIVLQELIKQDGKQSDSSEWKKQLAEWKEEYPLWYVDNEEEGFKPQKLIEYIHQFTKGEAIVATDVGQHQMWSAQFYPFQKADKWVTSGGLGTMGFGLPAAIGAQLAEKDATVVAVVGDGGFQMTLQELDVIRELNLPVKVVILNNACLGMVRQWQEIFYEERYSESKFASQPDFVKLSEAYGIKGIRISSEAEAKEKLEEALTSREPVVIDVRVASEEKVFPMVAPGKGLHEMVGVKP

SEQ ID NO: 1173 - protein, 308 aa, Pseudomonas aeruginosa
MNVIIKAVVTASTLLMVSFSSFETSAQSPLLKEQIESIVIGKKATVGVAVWGPDDLEPLLINPFEKFPMQSVFKLHLAMLVLHQVDQGKLDLNQTVIVNRAKVLQNTWAPIMKAYQGDEFSVPVQQLLQYSVSHSDNVACDLLFELVGGPAALHDYIQSMGIKETAVVANEAQMHADDQVQYQNWTSMKGAAEILKKFEQKTQLSETSQALLWKWMVETTTGPERLKGLLPAGTVVAHKTGTSGIKAGKTAATNDLGIILLPDGRPLLVAVFVKDSAESSRTNEAIIAQVAQTAYQFELKKLSALSPN

SEQ ID NO: 1174 - protein, 328 aa, Escherichia coli
MKLRSVTYALFIAGLAAFSTSSLAAQSLRFGYETSQTDSQHIAAKKFNDLLQERTKGELKLKLFPDSTLGNAQAMISGVRGGTIDMEMSGSNNFAGLSPVMNLLDVPFLFRDTAHAHKTLDGKVGDDLKASLEGKGLKVLAYWENGWRDVTNSRAPVKTPADLKGLKIRTNNSPMNIAAFKVFGANPIPMPFAEVYTGLETRTIDAQEHPINVVWSAKFFEVQKFLSLTHHAYSPLLVVINKAKFDGLSPEFQQALVSSAQEAGNYQRKLVAEDQQKIIDGMKEAGVEVITDLDRKAFSDALGNQVRDMFVKDVPQGADLLKAVDEVQ

SEQ ID NO: 1175 - protein, 333 aa, Rhodobacter capsulatus
MLTRRILGALVGATALSLALSVPALAEPIVIKFSHVVAPDTPKGKGAAKFEELAEKYTNGAVDVEVYPNSQLYKDKEELEALQLGAVQMLAPSLAKFGPLGVQDFEVFDLPYIFKDYEALHKVTQGEAGKMLLSKLEAKGITGLAFWDNGFKIMSANTPLTMPDDFLGLKMRIQSSKVLEAEMNALGAVPQVMAFSEVYQALQTGVVDGTENPPSNMFTQKMNEVQKHATVSNHGYLGYAVIVNKQFWDGLPADVRTGLEKAMAESTDYANGIAKEENEKALQAMKDAGTTEFHELTAEERAAWEEVLTPVHDEMAERIGAETIAAVKAATAE

SEQ ID NO: 1176 - protein, 319 aa, Solanum tuberosum
MAVNGSALSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEAEARKAIKVSDVELEFLTGSDKIDDESAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTESEALTLLKGGA

SEQ ID NO: 1177 - protein, 429 aa, Mesocricetus auratus
MALRVTRNTKLNTENKAKVSMAGAKAVPVTLAAASKPGLRPRTALGDIGNKVSEQAQARLPLKKELKTSVTGKVSAKIPPPKPLEKVPPVSEPEVELAETHEPEPVMDEKLSPEPILVDNPSPSPMETSGCAPAEEYLCQAFSDVILAVSDVDADDGADPNLCSEYVKDIYAYLRQLEEEQSVRPKYLLGREVTGNMRAILIDWLIQVQMKFRLLQETMYMTVSIIDRFMQDNCVPKKMLQLVGVTAMFIASKYEEMYPPEIGDFAFVTNNTYTKHQIRQMEMKILRVLNFSLGRPLPLHFLRRTSKIGEVDVEQHTLAKYLMELTLLDYDMVDFAPSQIAAGAFCLALKILDNGEWTPTLQHYLSYTEESLLPVMQHLAKNVVMVNHGLTKHMTIKNKYATSKHAKISTLAQLNCTLVQNLSKAVAKA

SEQ ID NO: 1178 - protein, 397 aa, Mesocricetus auratus
MALLRRPTVSSDLKNIDTGVNPKAKSHVTIRRAVLEEIGNKVRSRAAPVAKKPQNTKIPVQPTKVTHVNKQPKPTASVKPVQMETLAPKDPPAPEDVSMKEENLCQAFSDALLCKIEDIDNEDWENPQLCSDYVKDIYQYLRQLEVLQSINPHFLDGRDINGRMRAILVDWLVQVHSKFRLLQETLYMCIAIMDRFLQAQPVCRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSQVAAAASCLSQKVLGQGKWNLKQQYYTGYMETEVLEVMQHMAKNVVKVNENLTKFIAVKNKYASSRLLKISTIPQLNSKTIKDLASPLMGRL

SEQ ID NO: 1179 - protein, 73 aa, Saccharomyces cerevisiae
LVLGALLDTSHKFRNLDKDLCEKCAKCISMIGVLDVTKHEFKRTTYSENEVYDLNDSVQTIKFLIWVINDILV

SEQ ID NO: 1180 - protein, 88 aa, Saccharomyces cerevisiae
VLGALLDTSHKFRNLDKDLCEKCAKCISMIGVLDVTKHEFKRTTYSENEVYDLNDSVQTIKFLIWVINDILVPAFWQSENPSKQLFVA

SEQ ID NO: 1181 - protein, 270 aa, Saccharomyces cerevisiae
MSRTIPFLFKLVNRAVILPTAGFTLGVGAFVKAWPDDAGVLSLNDPQTPAELISATKSRQPMELQRVDILAQIEKSEVYNKLAQDEKMHHVLFSEKIPSGHREYHVGQGLLFGKGKLEIDPLVFHDVNHGELTVIYHLGAELGNRDGNVHKGLLSLLLDEALCYCGFPLLPSKRGVTARLSLEFFEDIPVDTTIILKANVKEIKGRKCIIEGHLEQFPLEVSSRNGTRSWNLPHIWGFNHKQEMAKKFAKANCILVEPTWFKYFKWLDMF

SEQ ID NO: 1182 - protein, 69 aa, Saccharomyces cerevisiae
KFQFGSLCVTHMVLLLVVFQAHLIIKNVLNGLFWFLLPCGLVIVNDIFAYLCGITFGKTKLIEISPKKT

SEQ ID NO: 1183 - protein, 198 aa, Saccharomyces cerevisiae
NPEMKPHGTSKEIVESVTDATSKAIDKLQEELHKDASESVTPVTKESTAATKESRKYNFFIRTVWTFVMISGFFITLASGHAWCIVLILGCQIATFKECIAVTSASGREKNLPLTKTLNWYLLFTTIYYLDGKSLFKFFQATFYEYPVLNFIVTNHKFICYCLYLMGFVLFVCSLRKGFLKFQFGSLCVTHMVLLLVV

SEQ ID NO: 1184 - protein, 237 aa, Saccharomyces cerevisiae
MKTAYLASLVLIVSTAYVIRLIAILPFFHTQAGTEKDTKDGVNLLKIRKSSKKPLKIFVFLGSGGHTGEMIRLLENYQDLLLGKSIVYLGYSDEASRQRFAHFIKKFGHCKVKYYEFMKAREVKATLLQSVKTIIGTLVQSFVHVVRIRFAMCGSPHLFLLNGPGTCCIISFWLKIMELLLPLLGSSHIVYVESLARINTPSLTGKILYWVVDEFIVQWQELRDNYLPRSKWFGILV

SEQ ID NO: 1185 - protein, 70 aa, Saccharomyces cerevisiae
KVKYYEFMKAREVKATLLQSVKTIIGTLVQSFVHVVRIRFAMCGSPHLFLLNGPGTCCIISFWLKIMELL

SEQ ID NO: 1186 - protein, 187 aa, Saccharomyces cerevisiae
QAGTEKDTKDGVNLLKIRKSSKKPLKIFVFLGSGGHTGEMIRLLENYQDLLLGKSIVYLGYSDEASRQRFAHFIKKFGHCKVKYYEFMKAREVKATLLQSVKTIIGTLVQSFVHVVRIRFAMCGSPHLFLLNGPGTCCIISFWLKIMELLLPLLGSSHIVYVESLARINTPSLTGKILYWVVDEFIV

SEQ ID NO: 1187 - protein, 66 aa, Saccharomyces cerevisiae
LICTFTPVLTVIYNKYFVEPMTKWENHSSVVNAKKSKEAKNFVIIFLSSYVPLLITLFLYLPMGHL

SEQ ID NO: 1188 - protein, 56 aa, Saccharomyces cerevisiae
VEPMTKWENHSSVVNAKKSKEAKNFVIIFLSSYVPLLITLFLYLPMGHLLTAEIRT

SEQ ID NO: 1189 - protein, 141 aa, Saccharomyces cerevisiae
HAQKWQHIPLSQLIEQNKLIFVPGSISVEEAFNTLIKYHLNSIPVESFPGDMNCFTFDYNDLNSYLLLVLNKITVSNKQLTADCQNGKPVPVGEMVKLTPKNPFYKLPENESLSTVMGILGSGVHRVAITNEEMTKVKGIL

SEQ ID NO: 1190 - protein, 170 aa, Saccharomyces cerevisiae
KLSAVPMTQTPSQCLSCVHAQKWQHIPLSQLIEQNKLIFVPGSISVEEAFNTLIKYHLNSIPVESFPGDMNCFTFDYNDLNSYLLLVLNKITVSNKQLTADCQNGKPVPVGEMVKLTPKNPFYKLPENESLSTVMGILGSGVHRVAITNEEMTKVKGILSQRRLIKYLWD

SEQ ID NO: 1191 - protein, 69 aa, Saccharomyces cerevisiae
KLWKYHNGLNQIVDLNIVGKLCKINACFASLVLFTDTHCYTLKVTNGDVDKDSLTELDINENVISVASG

SEQ ID NO: 1192 - protein, 47 aa, Saccharomyces cerevisiae
WKYHNGLNQIVDLNIVGKLCKINACFASLVLFTDTHCYTLKVTNGDV

SEQ ID NO: 1193 - protein, 217 aa, Escherichia coli
MDIISVALKRHSTKAFDASKKLTPEQAEQIKTLLQYSPSSTNSQPWHFIVASTEEGKARVAKSAAGNYVFNERKMLDASHVVVFCAKTAMDDVWLKLVVDQEDADGRFATPEAKAANDKGRKFFADMHRKDLHDDAEWMAKQVYLNVGNFLLGVAALGLDAVPIEGFDAAILDAEFGLKEKGYTSLVVVPVGHHSVEDFNATLPKSRLPQNITLTEV

SEQ ID NO: 1194 - protein, 73 aa, Saccharomyces cerevisiae
MAEIKHYQFNVVMTCSGCSGAVNKVLTKLEPDVSKIDISLEKQLVDVYTTLPYDFILEKIKKTGKEVRSGKQL

SEQ ID NO: 1195 - protein, 418 aa, Neurospora crassa
MSLSNKLSIEDVDLKGKRVLIRVDFNVPLDAEKKVTNPQRIAGAIPTIKYALDHGAKAVVLMSHLGRPDGKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 1196 - protein, 327 aa, Saccharomyces cerevisiae
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 1197 - protein, 117 aa, Saccharomyces cerevisiae
LIDLVDEIGSHDAEILKLHCNIFVLYINMAMTHIVTQIQADSTKFLSHLLKYCGDEVVRKSWVKLLNGVFGVLGWGQVGKNDSASIVQTKKRNAKYVTIHLNALYTLVEYGCQDERA

SEQ ID NO: 1198 - protein, 43 aa, Saccharomyces cerevisiae
VLYINMAMTHIVTQIQADSTKFLSHLLKYCGDEVVRKSWVKLL

SEQ ID NO: 1199 - protein, 239 aa, Saccharomyces cerevisiae
MMSCLVPTRFTLTLNTACLLTSTWGFVRATSVVLPPSLSKAGHKQFLTIISIIATIINNAVNISNYYIQRNNKMNLETKKKSDFISRHVTLPVSLVLESIVATVYWPLRLFFVNLIMHGVESTAKTPFPMTVDMAIHLYPILYLLADHYLSGSGTKFKLSNKHAWLIVTSLAFSYFQYLAFLIDAGQGQAYPYPFLDVNEPYKSIIFVVVATITWAYYVFYQKFPPKYIKKSAKKGDKN

SEQ ID NO: 1200 - protein, 105 aa, Saccharomyces cerevisiae
IQRNNKMNLETKKKSDFISRHVTLPVSLVLESIVATVYWPLRLFFVNLIMHGVESTAKTPFPMTVDMAIHLYPILYLLADHYLSGSGTKFKLSNKHAWLIVTSLA

SEQ ID NO: 1201 - protein, 46 aa, Saccharomyces cerevisiae
KMNLETKKKSDFISRHVTLPVSLVLESIVATVYWPLRLFFVNLIMH

SEQ ID NO: 1202 - protein, 630 aa, Saccharomyces cerevisiae
MSSERVLSYAPAFKSFLDTSFFQELSRLKLDVLKLDSTCQPLTVNLDLHNIPKSADQVPLFLTNRSFEKHNNKRTNEVPLQGSIFNFNVLDEFKNLDKQLFLHQRALECWEDGIKDINKCVSFVIISFADLKKYRFYYWLGVPCFQRPSSTVLHVRPEPSLKGLFSKCQKWFDVNYSKWVCILDADDEIVNYDKCIIRKTKVLAIRDTSTMENVPSALTKNFLSVLQYDVPDLIDFKLLIIRQNEGSFALNATFASIDPQSSSSNPDMKVSGWERNVQGKLAPRVVDLSSLLDPLKIADQSVDLNLKLMKWRILPDLNLDIIKNTKVLLLGAGTLGCYVSRALIAWGVRKITFVDNGTVSYSNPVRQALYNFEDCGKPKAELAAASLKRIFPLMDATGVKLSIPMIGHKLVNEEAQHKDFDRLRALIKEHDIIFLLVDSRESRWLPSLLSNIENKTVINAALGFDSYLVMRHGNRDEQSSKQLGCYFCHDVVAPTDSLTDRTLDQMCTVTRPGVAMMASSLAVELMTSLLQTKYSGSETTVLGDIPHQIRGFLHNFSILKLETPAYEHCPACSPKVIEAFTDLGWEFVKKALEHPLYLEEISGLSVIKQEVERLGNDVFEWEDDESDEIA

SEQ ID NO: 1203 - protein, 65 aa, Saccharomyces cerevisiae
AEKRISVLMKLQCYTGTVQLSHVQEKLHLPYITTNGIVDVFKECLKRTKKQYPEVLKNWWIDLDP

SEQ ID NO: 1204 - protein, 59 aa, Saccharomyces cerevisiae
ISVLMKLQCYTGTVQLSHVQEKLHLPYITTNGIVDVFKECLKRTKKQYPEVLKNWWIDL

SEQ ID NO: 1205 - protein, 181 aa, Bacillus subtilis
MSSFHATTIFAVQHKGRSAMSGDGQVTFGQAVVMKHTARKVRKLFNGKVLAGFAGSVADAFTLFEKFEAKLEEYNGNLKRAAVELAKEWRSDKVLRKLEAMLIVMNQDTLLLVSGTGEVIEPDDGILAIGSGGNYALAAGRALKKHAGESMSASEIARAALETAGEICVYTNDQIILEELE

SEQ ID NO: 1206 - protein, 91 aa, Saccharomyces cerevisiae
KPANIMVTIDGCVKIGDLGLARKFHNMLQTLYTGDKVVVTIWYRAPELLLGARHYTPAVDLWSVGCIFAELIGLQPIFKGEEAKLDSKKTV

SEQ ID NO: 1207 - protein, 31 aa, Saccharomyces cerevisiae
CVKIGDLGLARKFHNMLQTLYTGDKVVVTIW

SEQ ID NO: 1208 - protein, 139 aa, Saccharomyces cerevisiae
KKGNLTCIVGKVGSGKTALLSCMLGDLFRVKGFATVHGSVAYVSQVPWIMNGTVKENILFGHRYDAEFYEKTIKACALTIDLAILMDGDKTLVGEKGISLSGGQKARLSLARAVYARADTYLLDDPLAAVDEHVARHLI

SEQ ID NO: 1209 - protein, 78 aa, Saccharomyces cerevisiae
ATVHGSVAYVSQVPWIMNGTVKENILFGHRYDAEFYEKTIKACALTIDLAILMDGDKTLVGEKGISLSGGQKARLSLA

SEQ ID NO: 1210 - protein, 310 aa, Escherichia coli
MLHKKTLLFAALSAALWGGATQAADAAVVASLKPVGFIASAIADGVTETEVLLPDGASEHDYSLRPSDVKRLQNADLVVWVGPEMEAFMQKPVSKLPGAKQVTIAQLEDVKPLLMKSIHGDDDDHDHAEKSDEDHHHGDFNMHLWLSPEIARATAVAIHGKLVELMPQSRAKLDANLKDFEAQLASTETQVGNELAPLKGKGYFVFHDAYGYFEKQFGLTPLGHFTVNPEIQPGAQRLHEIRTQLVEQKATCVFAEPQFRPAVVESVARGTSVRMGTLDPLGTNIKLGKTSYSEFLSQLANQYASCLKGD

SEQ ID NO: 1211 - protein, 311 aa, Escherichia coli
MNKYLKYFSGTLVGLMLSTSAFAAAEYAVVLKTLSNPFWVDMKKGIEDEAKTLGVSVDIFASPSEGDFQSQLQLFEDLSNKNYKGIAFAPLSSVNLVMPVARAWKKGIYLVNLDEKIDMDNLKKAGGNVEAFVTTDNVAVGAKGASFIIDKLGAEGGEVAIIEGKAGNASGEARRNGATEAFKKASQIKLVASQPADWDRIKALDVATNVLQRNPNIKAIYCANDTMAMGVAQAVANAGKTGKVLVVGTDGIPEARKMVEAGQMTATVAQNPADIGATGLKLMVDAEKSGKVIPLDKAPEFKLVDSILVTQ

SEQ ID NO: 1212 - protein, 881 aa, Saccharomyces cerevisiae
MRFSHFLKYNAVPEWQNHYMDYSELKNLIYTLQTDELQVGDNEEGFGAGKSSNITDRFKNKFSFKNAKEDTSSGMNKDAGIVEETIELRELPTAQTVAAKPSPFRRMKEKIFYKRRSSSASSVSSTANENLQLDTYDTFVGDLTAEKQKVDDFYKRTEAKFYDKFDALVKDLKKIGVIEYDIDDDTLFNEPIASTNDEVPPLDLDDDEDDDEFYDDQSNIEDNTALLHHSQYNIKSQKKSLLKKSIVNLYIDLCQLKSFIELNRIGFAKITKKSDKVLHLNTRTELIESEQFFKDTYAFQAETIELLNSKISQLVTFYARITDRPHNISHSKQELKSYLHDHIVWERSNTWKDMLGLLSQADELTPKETEYNANKLVGKLDLEYYRWPLPRPINLKFTSINNVALPKLFFTKKAYKIYFIILVTGLLLGIKTFNDAAQHRCMALVECVAFLWASEAIPLHITAFLVPLLVVLFKVLKTSDGAIMSAASASSEILAAMWSSTIMILLAGFTLGEVLAQYNIAKVLASWLLAFAGCKPRNVLLMAMCVVFFLSMWISNVAAPVLTYSLLSPLLDAMDADSPFAQALVLGVALAANIGGMSSPISSPQNIISMSYLKPYGIGWGQFFAVALPSGILAMLLVWILLFTTFKMNKTKLEKFKPIKTKFTVKQYYIITVTVATILLWCVESQIEGAFGSSGQIAIIPIVLFFGTGLLSTQDLNAFPWSIVILAMGGIALGKAVSSSGLLSTIAKALQKKIENDGVFAILCIFGILMLVVGTFVSHTVSAIIIIPLVQEVGDKLGNPKAAPILVFGCALLSSCGMGLASSGFPNVTAISKVDRKGDRYLSVMTFLTRGVPASILAFLCVITLGYGIMASVVKGNATSA

SEQ ID NO: 1213 - protein, 82 aa, Saccharomyces cerevisiae
TKKAYKIYFIILVTGLLLGIKTFNDAAQHRCMALVECVAFLWASEAIPLHITAFLVPLLVVLFKVLKTSDGAIMSAASASSE

SEQ ID NO: 1214 - protein, 73 aa, Saccharomyces cerevisiae
KKAYKIYFIILVTGLLLGIKTFNDAAQHRCMALVECVAFLWASEAIPLHITAFLVPLLVVLFKVLKTSDGAIM

SEQ ID NO: 1215 - protein, 481 aa, Bacillus subtilis
MARGLALILFSLLMVFGSAAHAEDDPIAALIQLNKQMIKSVKDGDMDSAQQTFDTFKAKWKKEEPSIKKENLSSHSEMDANIAMISLSFINQDARKLKTQLEELASHLETYQQAVVLKKTSSGQSRASLTAYIQSLKDTKQFIEKKQLDEASSAIDNLVTSWLAVEGDVVSQSKEAYTTSEENLALMKAEIGSHPEKVSKQIDEMIQLLEPIASSSYSWWDAALIPVREGMEALLVIGALLTMTKKARVTRSSTWIWGGASAGMAVSLAAGIGVTVLFSSSVFGENNFLLGGVTGVLSAVMLLYVGVWLHRNASMDKWREKINIQKSQALKKRSLLSFALIAFLAVVREGLETVIFFIGLVGKLPLTELIGGTAAGLIVLVIVGVLMIKLGMRIPLKPFFLLSMAVVLYMCVKFLGTGVHSLQLAGILPSDAESWLPSVSVLGIYPSVYSTIPQMLILLFLLIALVSEAAKHFTNGKELTK

SEQ ID NO: 1216 - protein, 271 aa, Bacillus subtilis
MSMHKALTIAGSDSSGGAGIQADLKTFQEKNVYGMTALTVIVAMDPNNSWNHQVFPIDTDTIRAQLATITDGIGVDAMKTGMLPTVDIIELAAKTIKEKQLKNVVIDPVMVCKGANEVLYPEHAQALREQLAPLATVITPNLFEASQLSGMDELKTVDDMIEAAKKIHALGAQYVVITGGGKLKHEKAVDVLYDGETAEVLESEMIDTPYTHGAGCTFSAAVTAELAKGAEVKEAIYAAKEFITAAIKESFPLNQYVGPTKHSALRLNQQS

SEQ ID NO: 1217 - protein, 399 aa, Saccharomyces cerevisiae [sequence omitted]

SEQ ID NO: 1218 - protein, 577 aa, Bacillus subtilis
MNKEALVNRLNASAKRQKADIVIKNGKIMDVYNQEWIYEDIAITDGVIVGLGEYEGENIIDAEGQMIVPGFIDGHVHIESSMVTPIEFAKAVLPHGVTTVVTDPHEIANVSGEKGIEFMLEQARHTPLNIHFMLPSSVPAASFERSGAILKAADLKPFYEEEEVLGLAEVMDYVSVQQAEKDMVQKLLDARVAGKRIDGHLAGLSTDLINIYRTAFVLNDHEVTSKEEALDRIRRGMYVMMREGSVAKNTLNVLPAVNEKNARRFFFCTDDKHVDDLLSEGSVNHQVKMAIQAGLNPFLAYQLGSLNAAECYGLDTKGAIAPGFDADLLFVSDLENVTVTMTMVKGQTVAEDSKAVYQDHASTAAPDQALLDSVKLAAPLNKQDFHMPIDSEQQINVIQIIPNQLETRLVQVPAPVAREFEPDTELDLLKIAVVERHKGLKETGLGVVKGFGFKSGAIATTISHDSHNIIAVGTNDEDIAAAVNKLQEIGGGLTIIKNGEELHSVPLPIAGLLSDQSAEQVNQSLLTLHDKLSLIGFTGGFNPFLTLSFLALPVIPDIKMTTTGLFDVKSFQHISLQ

SEQ ID NO: 1219 - protein, 491 aa, Bacillus subtilis [sequence omitted]

SEQ ID NO: 1220 - protein, 168 aa, Glycine max
LLMGLPVGKHIFLCATVDEKLCMRAYTPTSSVHEVGYFDLVVKVYFKGVHPKFPTGGIMSQHLDSLPIGSVLDVKGPLGHIVYTGRGNFLVHGKPRFATRLAMLAGGTGITPIYQVVRAILKDPEDCTEMHVVYANRTEDDILLKEELDEWAKKYDRLKVWYVIQASI

SEQ ID NO: 1221 - protein, 449 aa, Saccharomyces cerevisiae
MSAPAQNYKIADISLAAFGRKEIELAEHEMPGLMAIRKAYGDVQPLKGARIAGCLHMTIQTAVLIETLVALGAEVTWSSCNIYSTQDHAAAAIAASGVPVFAWKGETEEEYLWCIEQQLFAFKDNKKLNLILDDGGDLTTLVHEKHPEMLEDCFGLSEETTTGVHHLYRMVKEGKLKVPAINVNDSVTKSKFDNLYGCRESLVDGIKRATDVMLAGKVAVVAGYGDVGKGCAAALRGMGARVLVTEIDPINALQAAMEGYQVVTMEDASHIGQVFVTTTGCRDIINGEHFINMPEDAIVCNIGHFDIEIDVAWLKANAKECINIKPQVDRYLLSSGRHVILLANGRLVNLGCATGHSSFVMSCSFSNQVLAQIALFKSNDKSFREKHIEFQKTGPFEVGVHVLPKILDEAVAKFHLGNLGVRLTKLSKVQSEYLGIPEEGPFKADHYRY

SEQ ID NO: 1222 - protein, 496 aa, Saccharomyces cerevisiae
MTAAHPVAQLTAEAYPKVKRNPNFKVLDSEDLAYFRSILSNDEILNSQAPEELASFNQDWMKKYRGQSNLILLPNSTDKVSKIMKYCNDKKLAVVPQGGNTDLVGASVPVFDEIVLSLRNMNKVRDFDPVSGTFKCDAGVVMRDAHQFLHDHDHIFPLDLPSRNNCQVGGVVSTNAGGLNFLRYGSLHGNVLGLEVVLPNGEIISNINALRKDNTGYDLKQLFIGAEGTIGVVTGVSIVAAAKPKALNAVFFGIENFDTVQKLFVKAKSELSEILSAFEFMDRGSIECTIEYLKDLPFPLENQHNFYVLIETSGSNKRHDDEKLTAFLKDTTDSKLISEGMMAKDKADFDRLWTWRKSVPTACNSYGGMYKYDMSLQLKDLYSVSAAVTERLNAAGLIGDAPKPVVKSCGYGHVGDGNIHLNIAVREFTKQIEDLLEPFVYEYIASKKGSISAEHGIGFHKKGKLHYTRSDIEIRFMKDIKNHYDPNGILNPYKYI

SEQ ID NO: 1223 - protein, 1215 aa, Saccharomyces cerevisiae
MTKKSFVSSPIVRDSTLLVPKSLIAKPYVLPFFPLYATFAQLYFQQYDRYIKGPEWTFVYLGTLVSLNILVMLMPAWNVKIKAKFNYSTTKNVNEATHILIYTTPNNGSDGIVEIQRVTEAGSLQTFFQFQKKRFLWHENEQVFSSPKFLVDESPKIGDFQKCKGHSGDLTHLKRLYGENSFDIPIPTFMELFKEHAVAPLFVFQVFCVALWLLDEFWYYSLFNLFMIISMEAAAVFQRLTALKEFRTMGIKPYTINVFRNKKWVALQTNELLPMDLVSITRTAEESAIPCDLILLDGSAIVNEAMLSGESTPLLKESIKLRPSEDNLQLDGVDKIAVLHGGTKALQVTPPEHKSDIPPPPDGGALAIVTKTGFETSQGSLVRVMIYSAERVSVDNKEALMFILFLLIFAVIASWYVWVEGTKMGRIQSKLILDCILIITSVVPPELPMELTMAVNSSLAALAKFYVYCTEPFRIPFAGRIDVCCFDKTGTLTGEDLVFEGLAGISADSENIRHLYSAAEAPESTILVIGAAHALVKLEDGDIVGDPMEKATLKAVGWAVERKNSNYREGTGKLDIIRRFQFSSALKRSASIASHNDALFAAVKGAPETIRERLSDIPKNYDEIYKSFTRSGSRVLALASKSLPKMSQSKIDDLNRDDVESELTFNGFLIFHCPLKDDAIETIKMLNESSHRSIMITGDNPLTAVHVAKEVGIVFGETLILDRAGKSDDNQLLFRDVEETVSIPFDPSKDTFDHSKLFDRYDIAVTGYALNALEGHSQLRDLLRHTWVYARVSPSQKEFLLNTLKDMGYQTLMCGDGTNDVGALKQAHVGIALLNGTEEGLKKLGEQRRLEGMKMMYIKQTEFMARWNQPQPPVPEPIAHLFPPGPKNPHYLKALESKGTVITPEIRKAVEEANSKPVEVIKPNGLSEKKPADLASLLLNSAGDAQGDEAPALKLGDASCAAPFTSKLANVSAVTNIIRQGRCALVNTIQMYKILALNCLISAYSLSIIYMAGVKFGDGQATVSGLLLSVCFLSISRGKPLEKLSKQRPQSGIFNVYIMGSILSQFAVHIATLVYITTEIYKLEPREPQVDLEKEFAPSLLNTGIFIIQLVQQVSTFAVNYQGEPFRENIRSNKGMYYGLLGVTGLALASATEFLPELNEAMKFVPMTDDFKIKLTLTLLLDFFGSWGVEHFFKFFFMDDKPSDISVQQVKIASK

SEQ ID NO: 1224 - protein, 312 aa, Saccharomyces cerevisiae
MPRLLATQSHVVHGYVGNKAATFPLQCLGWDVDCCNSVQFSNHTGYGLDKVFGTITRETDLKELLSGLFDNFSQDYQALLSGYLPNKNSVRCMGTYYAKFKEANPEMIWLMDPVMGDEGQLYVSEDVIPEYRKLALSPKQLVDIITPNQFELEILYGGEIKTKEHLKKALKKLHQTIPVIIVTSCDCKMFDDKDFIYCVASMEGKTPIVYRVPFIDSYFTGVGDLFSALLLDRVYKILSNPTTTLKFEDQVNNVLNVIQKVLKITRSYASGKMKAKMGSALEMKEMELRLIESRDIYETINIHQTDYIYARL

SEQ ID NO: 1225 - protein, 121 aa, Saccharomyces cerevisiae
LSPPVSLLPTISTLKKIEHVTDLNKEYVFVGDVHGNYDEFIELIDDKIGGLGENITMILLGDFIHKGPDSDKVVSYILNHKDQVKCVLGNHEILVMMAYLNPDFSKWVRRPKLMTPLTFST

SEQ ID NO: 1226 - protein, 146 aa, Saccharomyces cerevisiae
AATLSTALILFVACCVYTLYIFKFDNPRLSPPVSLLPTISTLKKIEHVTDLNKEYVFVGDVHGNYDEFIELIDDKIGGLGENITMILLGDFIHKGPDSDKVVSYILNHKDQVKCVLGNHEILVMMAYLNPDFSKWVRRPKLMTPLT

SEQ ID NO: 1227 - protein, 439 aa, Schizosaccharomyces pombe [sequence omitted]

SEQ ID NO: 1228 - protein, 98 aa, Saccharomyces cerevisiae
YLVCHMKNDDGSTNLKCLQIPLQEANPDVELSDYVMWEYNVPENTIVFSLHVNTLSRYKLLKMKSKNHNASEKQPDALLKTAEIILVTDTQTIVFDVI

SEQ ID NO: 1229 - protein, 92 aa, Saccharomyces cerevisiae
LKCLQIPLQEANPDVELSDYVMWEYNVPENTIVFSLHVNTLSRYKLLKMKSKNHNASEKQPDALLKTAEIILVTDTQTIVFDVISTVHPCGL

SEQ ID NO: 1230 - protein, 46 aa, Saccharomyces cerevisiae
MTSIQCSIHVLTKFLHAPLVVALPHFLTWLHFIVAILKKLEMVNSK

SEQ ID NO: 1231 - protein, 89 aa, Saccharomyces cerevisiae
TSIQCSIHVLTKFLHAPLVVALPHFLTWLHFIVAILKKLEMVNSKQVVAFWIHFLRRTMPWNSIVTLGNVLVCYMLDNLHPFLKKELEK

SEQ ID NO: 1232 - protein, 107 aa, Saccharomyces cerevisiae
KLAESEYGVDAALWQRAFPKLLALVFKTCPMAMALCRSIVCIRLVQVHEIILRVANDVDFKLKNVLPETIVNQWKLYLIAACTSLTSTFDQKLHIPSNIPQHGRKKS

SEQ ID NO: 1233 - protein, 96 aa, Saccharomyces cerevisiae
FPKLLALVFKTCPMAMALCRSIVCIRLVQVHEIILRVANDVDFKLKNVLPETIVNQWKLYLIAACTSLTSTFDQKLHIPSNIPQHGRKKSQQIFTV

SEQ ID NO: 1234 - protein, 141 aa, Saccharomyces cerevisiae
MSQVITKYLEHDLELLGLTGVEDKLQKDVKSSIELLRNAGIKIWMLTGDKVETARCVSISAKLISRGQYVHTITKVTRPEGAFNQLEYLKINRNACLLIDGESLGMFLKHYEQEFFDVVVHLPTVIACRCTPQQKADVALV

SEQ ID NO: 1235 - protein, 113 aa, Saccharomyces cerevisiae
LGLTGVEDKLQKDVKSSIELLRNAGIKIWMLTGDKVETARCVSISAKLISRGQYVHTITKVTRPEGAFNQLEYLKINRNACLLIDGESLGMFLKHYEQEFFDVVVHLPTVIAC

SEQ ID NO: 1236 - protein, 356 aa, Salmonella typhimurium
MSSNKTEKPTKKRLEDSAKKGQSFKSKDLIIACLTLGGIAYLVSYGSFNEFMGIIKIIIADNFDQSMADYSLAVFGIGLKYLIPFMLLCLVCSALPALLQAGFVLATEALKPNLSALNPVEGAKKLFSMRTVKDTVKTLLYLSSFVVAAIICWKKYKVEIFSQLNGNIVGIAVIWRELLLALVLTCLACALIVLLLDAIAEYFLTMKDMKMDKEEVKREMKEQEGNPEVKSKRREVHMEILSEQVKSDIENSRLIVANPTHITIGIYFKPELMPIPMISVYETNQRALAVRAYAEKVGVPVIVDIKLARSLFKTHRRYDLVSLEEIDEVLRLLVWLEEVENAGKDVIQPQENEVRH

SEQ ID NO: 1237 - protein, 484 aa, Lithobates catesbeiana
MALKSKPGIMNITPGSKISVIRSKRVIQANTISSCDIIISDGKISSVLAWGKHVTSGAKLLDVGDLVVMAGIIDPHVHVNEPGRTDWEGYRTATLAAAAGGITAIVDMPLNSLPPTTSVTNFHTKLQAAKRQCYVDVAFWGGVIPDNQVELIPMLQAGVAGFKCFLINSGVPEFPHVSVTDLHTAMSELQGTNSVLLFHAELEIAKPAPEIGDSTLYQTFLDSRPDDMEIAAVQLVADLCQQYKVRCHIVHLSSAQSLTIIRKAKEAGAPLTVETTHHYLSLSSEHIPPGATYFKCCPPVRGHRNKEALWNALLQGHIDMVVSDHSPCTPDLKLLKEGDYMKAWGGISSLQFGLPLFWTSARTRGFSLTDVSQLLSSNTAKLCGLGIVKEPLKWVMMLIWSSGILTKSFRCKKMIFITRISSPHIWDSFFKEKSWLLLFEGLLFISKGSMLPNQLENLFLYTLWSLVKPVHPVHPIIRKNLPHI

SEQ ID NO: 1238 - protein, 192 aa, Drosophila melanogaster
MQAIKCVVVGDGAVGKTCLLISYTTNAFPGEYIPTVFDNYSANVMVDAKPINLGLWDTAGQEDYDRLRPLSYPQTDVFLICFSLVNPASFENVRAKWYPEVRHHCPSTPIILVGTKLDLRDDKNTIEKLRDKKLAPITYPQGLAMAKEIGAVKYLECSALTQKGLKTVFDEAIRSVLCPVLQPKSKRKCALL

SEQ ID NO: 1239 - protein, 94 aa, Schizosaccharomyces pombe
VIDWKGYSLQYFGQLLVWDVVNVCKADIEREYHVYLFEKILLCCKEMSTLKRQARSISMNKKTKRLDSLQLKGRILTSNITTVVPNHHMGSYAI

SEQ ID NO: 1240 - protein, 77 aa, Schizosaccharomyces pombe
YFGQLLVWDVVNVCKADIEREYHVYLFEKILLCCKEMSTLKRQARSISMNKKTKRLDSLQLKGRILTSNITTVVPNH

SEQ ID NO: 1241 - protein, 319 aa, Oryza sativa
MAIKRTKAEKKVAYDKKLCQLLDEYTKVLIAVADNVGSNQLQEIRKGLRGDSIVLMGKNTLIRRCIKVHADNTGNKEFLELMPLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLVITNVYDSGSVFSPEVLDLTEDDLMEKFASGVSMVASVSLAISYPTIAAAPHMFLNGYKNVLAVAVETEYSYPHADKIKEYLKDPSKFAVAAPVAADSGAAAPSAAKEEEKKEEPEEESDGDLGMSLFD

SEQ ID NO: 1242 - protein, 172 aa, Mus musculus
IQNLVKVYRDGMKVAVDGLALNFYEGQITSFLGHNGAGKTTTMSILTGLFPPTSGTAYILGKDIRSEMSSIRQNLGVCPQHNVLFDMLTVEEHIWFYARLKGLSEKHVKAEMEQMALDVGLPPSKLKSKTSQLSGGMQRKLSVALAFVGGSKVVILDEPTAGVDPYSRRGIW

SEQ ID NO: 1243 - protein, 184 aa, Mus musculus
VVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQNVKDVVRFFNRNFPEAMLKERHHTKVQYQLKSEHISLAQVFSKMEQVVGVLGIEDYSV

SEQ ID NO: 1244 - protein, 48 aa, Mus musculus
KEHRLKEVMKTMGLNNAVHWVAWFITGFVQLSISVTALTAILKYCQVL

SEQ ID NO: 1245 - protein, 145 aa, Escherichia coli
MRATDKQRGFTLLEIMVVIVIIGVLASLVVPNLMGNKEKADKQKAVSDIVALENALDMYKLDNHHYPTTNQGLESLVEAPTLPPLAANYNKEGYIKRLPADPWGNDYVLVNPGEHGAYDLLSAGPDGEMGTEDDITNWGLSKKKK

SEQ ID NO: 1246 - protein, 743 aa, Colwellia maris
MSTDNSKIIYTITDEAPALATYSLLPIIQAYTASSGINVETRDISLAGRILANFPKYLTKEQRIDDALAELGELAQTPEANIIKLPNISASIPQLEAVIKELQAKGYDLPHYPAEPQNEAEESIKLTYAKILGSAVNPVLREGNSDRRAPASVKQYARNNPHSMGAWSKESKSHVAHMASGDFYGSEKSVTIDGATSVNIEFVAKNGDVTLLKSKLPLLDKEIIDASVMSKSALVEFFETEINKAKEEDVLLSLHLKATMMKVSDPVMFGHAVRVFYKDVFAKHAATFEQLGVDADNGIGDVYAKIARLPAAQKEEIEADLQAVYATRPEMAMVDSDKGITNLHVPSDVIIDASMPAALRASGMMWGPDGKQKDTKFMIPDRNYAGVFSAVVDFCRENGAFNPATMGTVPNVGLMAQKAEEYGSHDKTFTMKAAGTVRVVNSQGERLIEQEVAQGDIYRMCQVKDAPIQDWVKLAVTRARATGTPTVFWLDENRGHDEQMIKKVNTYLADHDTTGLDIQILEPVKACEFTLARVAKGEDAISVTGNVLRDYLTDLFPILELGTSAKMLSIVPLMNGGGLFETGAGGSAPKHVQQFEKENHLRWDSLGEFLALAASLEHVAVTTGNARAQILADTLDAATGKFLDTNKSPSRKVGELDNRGSHFYLAMYWAQALAAQTTDTELQASFSSVAQALTKQEEKIVAELNAAQGPAIDLNGYYFADTKLAEKAMRPSETFNTILSALL

SEQ ID NO: 1247 - protein, 537 aa, Pinus taeda
MANGIKKVEHLYRSKLPDIEISDHLPLHSYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEIMKGYINDPESTAATIDEEGWLHTGDVEYIDDDEEIFIVDRVKEIIKYKGFQVAPAELEALLVAHPSIADAAVVPQKHEEAGEVPVAFVVKSSEISEQEIKEFVAKQVIFYKKIHRVYFVDAIPKSPSGKILRKDLRSRLAAK

SEQ ID NO: 1248 - protein, 238 aa, Mus musculus
MAVEGGMKCVKFLLYVLLLAFCACAVGLIAIGVAVQVVLKQAITHETTAGSLLPVVIIAVGAFLFLVAFVGCCGACKENYCLMITFAIFLSLIMLVEVAVAIAGYVFRDQVKSEFNKSFQQQMQNYLKDNKTATILDKLQKENNCCGASNYTDWENIPGMAKDRVPDSCCINITVGCGNDFKESTIHTQGCVETIAIWLRKNILLVAAAALGIAFVEVLGIIFSCCLVKSIRSGYEVM

SEQ ID NO: 1249 - protein, 416 aa, Schistosoma mansoni
MGLSKLSISDVDLKGKRVLIRVDFNVPMKDGKVTNTQRIAAAIPTIKYALDKGAKSVVLMSHLGRPDGHKVDKYSLKPVCPEVSKLLGKEVTFLNDCVGPDVVNACANPAPGSVFLLENLRFHVEEEGKGVSPTGEKTKATADQIKAFSESLTKLGDVYVNDAFGTAHRAHASMVGCQLPQKACGFLMNKELTYFAKALENPERPFLAILGGAKVSDKIQLINNMLDKVNELIIGGGMAYTFLKQIHNMHIGNSLFDAPGAEIVHKVMETAKAKNVAIHLPVDFVTADKFADDANTEIRTIQSGIADGWMGLDIGPKTIEEFSKVISRAKTIVWNGPMGVFEMDKFATGTKAAMDEVVKATKNGATTIIGGGDTATCCAKWDTEDKVSHVSTGGGASLELLEGKQLPGVVALTDAH

SEQ ID NO: 1250 - protein, 973 aa, Saccharomyces cerevisiae
MTSLSSQPAYTLVFDPSPSMETYSSTDFQKALEKGSDEQKIDTMKSILVTMLEGNPMPELLMHIIRFVMPSKNKELKKLLYFYWEIVPKLAEDGKLRHEMILVCNAIQHDLQHPNEYIRGNTLRFLTKLREAELLEQMVPSVLACLEYRHAYVRKYAILAVFSIFKVSEHLLPDAKEIINSFIVAETDPICKRNAFIGLAELDRENALHYLENNIADIENLDPLLQAVFVQFIRQDANRTPALKAQYIELLMELLSTTTSDEVIFETALALTVLSANPNVLVPAVNKLIDLAVKVSDNNIKLIVLDRIQDINANNVGALEELTLDILRVLNAEDLDVRSKALDISMDLATSRNAEDVVQLLKKELQTTVNNPDQDKAMQYRQLLIKTIRTVAVNFVEMAASVVSLLLDFIGDLNSVAASGIIAFIKEVIEKYPQLRANILENMVQTLDKVRSAKAYRGALWIMGEYAEGESEIQHCWKHIRNSVGEVPILQSEIKKLTQNQEHTEENEVDATAKPTGPVILPDGTYATESAFDVKTSQKSVTDEERDSRPPIRRFVLSGDFYTAAILANTIIKLVLKFENVSKNKTVINALKAEALLILVSIVRVGQSSLVEKKIDEDSLERVMTSISILLDEVNPEEKKEEVKLLEVAFLDTTKSSFKRQIEIAKKNKHKRALKDSCKNIEPIDTPISFRQFAGVDSTNVQKDSIEEDLQLAMKGDAIHATSSSSISKLKKIVPLCGFSDPVYAEACITNNQFDVVLDVLLVNQTKETLKNLHVQFATLGDLKIIDTPQKTNVIPHGFHKFTVTVKVSSADTGVIFGNIIYDGAHGEDARYVILNDVHVDIMDYIKPATADDEHFRTMWNAFEWENKISVKSQLPTLHAYLRELVKGTNMGILTPSESLGEDDCRFLSCNLYAKSSFGEDALANLCIEKDSKTNDVIGYVRIRSKGQGLALSLGDRVALIAKKTNKLALTHV

SEQ ID NO: 1251 - protein, 540 aa, Saccharomyces cerevisiae
MVFTKEEVDYSLYLVTDSTMLPPGTTLCSQVEAGLKNGVTLVQIREKDIETKNFVAEALEVQKICKKYNVPLIINDRIDVAMAIDADGVHVGQDDMPIPMVRKLLGPSKILGWSVGKPSEVETLAKWGPDMVDYIGVGTLFPTSTKKNPKKSPMGPQGAIAILDALEEFKATWCRTVGIGGLHPDNIQRVLCQCVASNGKRSLDGISLVSDIMAAPDACAATKRLRGLLDATRYQFVECELNNTFPTTTSIQNVISQVSNNRPLVQHITNKVHQNFGANVTLALGSSPIMSEIESEVSELARIPNASLLLNTGSVAPIEMLKAAINAYNEVNRPITFDPVGYSATETRLCLNNTLLTYGQFACIKGNCSEILSLAKLNNHKMKGVDSSSGKTNIDTLVRATQIVAFQYRTVAVCTGEFDCVADGTFGGEYKLSSGTEGITAEDLPCVIIEDGPIPIMGDITASGCSLGSTIASFIGGLDSTGKLFDAVVGAVLLYKSAGKLASTRCQGSGSFHVELIDALYQLFHENKPEKWSASLKKFK

SEQ ID NO: 1252 - protein, 152 aa, Schizosaccharomyces pombe
ETVAVKKVKLSKMLKSDLSVIKMEIDLLKNLDHPNIVKYRGSYQTNDSLCIILEYCENGSLRSICKNFGKIPENLVALYTFQVLQGLLYLHNQGVIHRDIKGANILTTKDGTIKLADFGVATKINALEDHSVVGSPYWMAPEVIELVGATTA

SEQ ID NO: 1253 - protein, 160 aa, Schizosaccharomyces pombe
VAVKKVKLSKMLKSDLSVIKMEIDLLKNLDHPNIVKYRGSYQTNDSLCIILEYCENGSLRSICKNFGKIPENLVALYTFQVLQGLLYLHNQGVIHRDIKGANILTTKDGTIKLADFGVATKINALEDHSVVGSPYWMAPEVIELVGATTASDIWSVGCTV

SEQ ID NO: 1254 - protein, 119 aa, Saccharomyces cerevisiae
QGTAVERTKVKELYDVLMEKMLLVDKVKFGYNMLEDYVLKYTWSGLGYVFASIPIVMSTLATGINSEEKNMKEFIVNKRLMLSLADAGSRLMHSIKDISQLTGYTNRIFTLLSVLHRVH

SEQ ID NO: 1255 - protein, 110 aa, Saccharomyces cerevisiae
VKELYDVLMEKMLLVDKVKFGYNMLEDYVLKYTWSGLGYVFASIPIVMSTLATGINSEEKNMKEFIVNKRLMLSLADAGSRLMHSIKDISQLTGYTNRIFTLLSVLHRVH

SEQ ID NO: 1256 - protein, 309 aa, Caenorhabditis elegans
MLSSTCTAAVRGLSTTAQLSKINNVTIIGAGLMGSGIAQVSANAKLNVTVVDSNQSALEKAQQGIANSLKRVAKKKHADDAAAQTALVSSVLDRIKMSTNVSDSVKDADLVIEAIVENIDIKRKLFAEVEVAAKPTTLITTNTSSLRLADIGLNLKDKSRFGGLHFFNPVPMMKLLEVVRHTETSDATFNQLVDYGKTVGKTTVACKDTPGFIVNRLLVPYMFEALRLYERGDASMEDIDVAMKLGAGYPMGPFELSDYVGLDTCKFIMDGWHAQYPEEVAFTPSPLLNSLVDSGKNGRKSGEGFYKYK

SEQ ID NO: 1257 - protein, 255 aa, Caenorhabditis elegans
MTSGLILTERKNNVLWVTLNRPKKFNALTRQMFLDLCTVFNDAADDDDIAFVVFTGGKGKYYCAGSDFSPAELSTLTDIQEHGYKLFVDILIAFPKPIIALVNGHAVGVSVTMLGVMDAVIAIDTATFATPFADIGVCPEACSSYTLPRIMGHQKAAALMMFSEKFTAHEAHIAGLVTQILPAATFEKDAKKIIDRYSKLSPITMKVAKELMRTTQIKDELLTVNRKEQVHLNGMFSHEDTIARLTAKFVKPSKI

SEQ ID NO: 1258 - protein, 484 aa, Hordeum vulgare
MECVRSGALDLGRSGNFLGKSGSTTSCGKVRCSTNLAGSTKCEQNLHGKAKPLLLSASGKARGTSGLVHRSPVLKHQHHLSVRSTSTDVCTTFDEDVKGVSSHAVEEKVGVLLLNLGGPETLNDVQPFLFNLFADPDIIRLPRLFRFLQRPLAKLISTFRAPKSNEGYASIGGGSPLRKITDEQANALKVALKSKNLEADIYVGMRYWYPFTEEAIDQIKKDKITKLVVLPLYPQYSISTSGSSIRVLQNIVKEDPYFAGLPISIIESWYQREGYVKSMADLIEKELSVFSNPEEVMIFFSAHGVPLTYVKDAGDPYRDQMEDCIALIMEELKSRGTLNDHTLAYQSRVGPVQWLKPYTDEVLVELGQKGVKSLLAVPVSFVSEHIETLEEIDMEYRELALESGIENWGRVPALGCTSSFISDLADAVVEALPSASAMATRKVKDTDSDMDMMHYLTKMFLGSVLAFFLLLSPRLVSAFRNTLQ

SEQ ID NO: 1259 - protein, 421 aa, Bacillus subtilis
MPKQIDTILINIGQLLTMESSGPRAGKSMQDLHVIEDAVVGIHEQKIVFAGQKGAEAGYEADEIIDCSGRLVTPGLVDPHTHLVFGGSREKEMNLKLQGISYLDILAQGGGILSTVKDTRAASEEELLQKAHFHLQRMLSYGTTTAEVKSGYGLEKETELKQLRVAKKLHESQPVDLVSTFMGAHAIPPEYQNDPDDFLDQMLSLLPEIKEQELASFADIFTETGVFTVSQSRRYLQKAAEAGFGLKIHADEIDPLGGAELAGKLKAVSADHLVGTSDEGIKKLAEAGTIAVLLPGTTFYLGKSTYARARAMIDEGVCVSLATDFNPGSSPTENIQLIMSIAALHLKMTAEEIWHAVTVNAAYAIGKGEEAGQLKAGRSADLVIWQAPNYMYIPYHYGVNHVHQVMKNGTIVVNREGAILG

SEQ ID NO: 1260 - protein, 334 aa, Xenopus laevis
MASVQEKLITCVCQDKPAKPTNKITIVGVGQVGMACAVSVLLKELADELALVDILEDKLKGEMMDLQHGSLFLKTPTIVADKDYSVTANSRIVVVTGGVRQQEGESRLNLVQRNVNIFKFIIPQIVKYSPDCIILVVSNPVDILTYVTWKLSGLPQHRIIGSGTNLDSARFRHLIAEKLGVHPTSCHGFILGEHGDSSVAVWSGVNVAGVSLQSLKPDIGTDEDCCKWKEVHKQVVDSAYEVIKLKGYTNWAIGFSVAEIVESITKNLGRVHPVSTMVKGMYGIETEVFLSLPCVLNGNGLTSVINQKLKDNEVGQLQKSAETLWSIQKDLKDL

SEQ ID NO: 1261 - protein, 393 aa, Acinetobacter sp.
MHPIVIIGSGMAGYTLAREFRKLNPEHELVMICADDAVNYAKPTLSNALSGNKAPEQIPLGDAEKMSTQLKLQILSETWVKAINPETHELKLEKNGQETIQPYSKLVLAVGANPTRLAIAGDGSDDIHVVNSLIDYRAFRENLAKRQDKRVVILGAGLIGCEFANDLQHTGHQVTVIDLSPRPLGRLLPAHIADAFQKNLEESGIHFVLSTTVEKVSKINDGQDYAVTLANGQTLVADIVLSAIGLQPNIDLAKHAGVHTSRGILTNSLLETNLEDIYAIGDCAEVNGTLLPYVMPIMQQARALAKTLSGETTHVHYPAMPVAVKTPAAPLTVLPVPVDVDVNWETEEFEDGMLAKAIDNTDTLRGFVLLGATAGKQRLTLTKLVPDLIPAQL

SEQ ID NO: 1262 - protein, 311 aa, Arabidopsis thaliana
MAKSPETEHPNKVFGWGARDKSGVLSPFHFSRRDNGENDVTVKILFCGVCHTDLHTIKNDWGYSYYPVVPGHEIVGIATKVGKNVTKFKEGDRVGVGVISGSCQSCESCDQDLENYCPQMSFTYNAIGSDGTKNYGGYSENIVVDQRFVLRFPENLPSDSGAPLLCAGITVYSPMKYYGMTEAGKHLGVAGLGGLGHVAVKIGKAFGLKVTVISSSSTKAEEAINHLGADSFLVTTDPQKMKAAIGTMDYIIDTISAVHALYPLLGLLKVNGKLIALGLPEKPLELPMFPLVLGRKMVGGSLLSLMLGTGS

SEQ ID NO: 1263 - protein, 445 aa, Ricinus communis
MAITIVSVRARQIFDSRGNPTVEADIKLSDGHLARAAVPSGASTGIYEALELRDGGSDYLGKGVSKAVENVNSIIGPALIGKDPTEQTALDNFMVQELDGTVNEWGWCKQKLGANAILAVSLALCKAGAHVKGIPLYKHIANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNDGSQKISGEALKDLYKSFASEYPIVSIEDPFDQDDWEHYSKLTSEIGEKVQIVGDDLLVTNPKRVEKAIQEKACNALLLKVNQIGSVTESIEAVRMSKRAGWGVMASHRSGETEDTFIADLSVGLATGQIKTGAPCRSERLAKYNQLLRIEEELGAEAVYAGAKFRTPVEPY

SEQ ID NO: 1264 - protein, 548 aa, Mus musculus
MALHVPKAPGFAQMLKDGAKHFSGLEEAVYRNIQACKELAQTTRTAYGPNGMNKMVINRLEKLFVTNDAATILRELEVQHPAAKMIVMASHMQEQEVGDGTNFVLVFAGALLELAEELLRIGLSVSEVISGYEIACKKAHEILPELVCCSAKNLRDVDEVSSLLRTSIMSKQYGSETFLAKLIAQACVSIFPDSGNFNVDNIRVCKILGSGIYSSSVLHGMVFKKETEGDVTSVKDAKIAVYSCPFDGMITETKGTVLIKTAEELMNFSKGEENLMDAQVKAIAGTGANVIVTGGKVADIALHYANKYNIMLVRLNSKWDLRRLCKTVGATALPKLTPPVQEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYSVHQEGNKNVGLDIEAEVPAVKDMLEASILDTYLGKYWAIKLATNAAVTVLRVDQIIMAKPAGGPKPPSGKKDWDDDQND

SEQ ID NO: 1265 - protein, 309 aa, Saccharomyces cerevisiae
MSKFVITCIAHGENLPKETIDQIAKEITESSAKDVSINGTKKLSARATDIFIEVAGSIVQKDLKNKLTNVIDSHNDVDVIVSVDNEYRQAKKLFVFDMDSTLIYQEVIELIAAYAGVEEQVHEITERAMNNELDFKESLRERVKLLQGLQVDTLYDEIKQKLEVTKGVPELCKFLHKKNCKLAVLSGGFIQFAGFIKDQLGLDFCKANLLEVDTDGKLTGKTLGPIVDGQCKSETLLQLCNDYNVPVEASCMVGDGGNDLPAMATAGFGIAWNAKPKVQKAAPCKLNTKSMTDILYILGYTDDEIYNRQ

SEQ ID NO: 1266 - protein, 572 aa, Mus musculus
MASTEGANNMPKQVEVRMHDSHLSSDEPKHRNLGMRMCDKLGKNLLLSLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPSEEANTTKAVISMLNETMNEAPEETKIVIKKGLEFKDGMNVLGLIGFFIAFGIAMGKMGEQAKLMVEFFNILNEIVMKLVIMIMWYSPLGIACLICGKIIAIKDLEVVARQLGMYMITVIVGLIIHGGIFLPLIYFVVTRKNPFSFFAGIFQAWITALGTASSAGTLPVTFRCLEDNLGIDKRVTRFVLPVGATINMDGTALYEAVAAIFIAQMNGVILDGGQIVTVSLTATLASIGAASIPSAGLVTMLLILTAVGLPTEDISLLVAVDWLLDRMRTSVNVVGDSFGAGIVYHLSKSELDTIDSQHRMQEDIEMTKTQSIYDDKNHRESNSNQCVYAAHNSVVIDECKVTLAANGKSADCSVEEEPWKREK

SEQ ID NO: 1267 - protein, 569 aa, Mus musculus
MVSANNMPKQVEVRMHDSHLSSDEPKHRNLGMRMCDKLGKNLLLSLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPSEEANTTKAVISMLNETMNEAPEETKIVIKKGLEFKDGMNVLGLIGFFIAFGIAMGKMGEQAKLMVEFFNILNEIVMKLVIMIMWYSPLGIACLICGKIIAIKDLEVVARQLGMYMITVIVGLIIHGGIFLPLIYFVVTRKNPFSFFAGIFQAWITALGTASSAGTLPVTFRCLEDNLGIDKRVTRFVLPVGATINMDGTALYEAVAAIFIAQMNGVILDGGQIVTVSLTATLASIGAASIPSAGLVTMLLILTAVGLPTEDISLLVAVDWLLDRMRTSVNVVGDSFGAGIVYHLSKSELDTIDSQHRMQEDIEMTKTQSIYDDKNHRESNSNQCVYAAHNSVVIDECKVTLAANGKSADCSVEEEPWKREK

SEQ ID NO: 1268 - protein, 558 aa, Mus musculus
MVSANNMPKQVEVRMHDSHLSSDEPKHRNLGMRMCDKLGKNLLLSLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPSEEANTTKAVISMLNETMNEAPEETKIVIKKGLEFKDGMNVLGLIGFFIAFGIAMGKMGEQAKLMVEFFNILNEIVMKLVIMIMWYSPLGIACLICGKIIAIKDLEVVARQLGMYMITVIVGLIIHGGIFLPLIYFVVTRKNPFSFFAGIFQAWITALGTASSAGTLPVTFRCLEDNLGIDKRVTRFVLPVGATINMDGTALYEAVAAIFIAQMNGVILDGGQIVTVSLTATLASIGAASIPSAGLVTMLLILTAVGLPTEDISLLVAVDWLLDRMRTSVNVVGDSFGAGIVYHLSKSELDTIDSQHRMQEDIEMTKTQSIYDDKNHRESNSNQCVYAAHNSVVIDECKVPFPFLDIETCI

SEQ ID NO: 1269 - protein, 350 aa, Candida albicans
MSEQIPKTQKAVVFDTNGGQLVYKDYPVPTPKPNELLIHVKYSGVCHTDLHARKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 1270 - protein, 198 aa, Rattus norvegicus
NLIIPCLFISFLTVLVFYLPSDCGEKVTLCISVLLSLTVFLLVITETIPSTSLVIPLVGEYLLFTMIFVTLSIVVTVFVLNIHYRTPATHTMPKWVKTMFLQVFPSILMMRRPLDKTKEMDGVKDPKTHTKRPAKVKFTHRKEPKLLKECRHCHKSSEIAPGKRLSQQPAQWVTENSEHPPDVEDVIDSVQFIAENMK

SEQ ID NO: 1271 - protein, 117 aa, Rattus norvegicus
ISVLLSLTVFLLVITETIPSTSLVIPLVGEYLLFTMIFVTLSIVVTVFVLNIHYRTPATHTMPKWVKTMFLQVFPSILMMRRPLDKTKEMDGVKDPKTHTKRPAKVKFTHRKEPKLL

SEQ ID NO: 1272 - protein, 405 aa, Arabidopsis thaliana
MASVGIAPNPGARDSTGVDKLPEEMNDMKIRDDKEMEATVVDGNGTETGHIIVTTIGGRNGQPKQTISYMAERVVGHGSFGVVFQAKCLETGETVAIKKVLQDRRYKNRELQTMRLLDHPNVVSLKHCFFSTTEKDELYLNLVLEYVPETVHRVIKHYNKLNQRMPLIYVKLYTYQIFRALSYIHRCIGVCHRDIKPQNLLVNPHTHQVKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPPEAVDLVSRLLQYSPNLRSAALDTLVHPFFDELRDPNARLPNGRFLPPLFNFKPHELKGVPLEMVAKLVPEHARKQCPWLGL

SEQ ID NO: 1273 - protein, 409 aa, Arabidopsis thaliana
MASVGIEPSAAVRESTGNVTDADRLPEEMKDMKIQDDKEMEATIVNGNVTETGHIIVTTIGGRNGQPKQTISYMAERVVGHGSFGVVFQAKCLETGETVAIKKVLQDRRYKNRELQTMRLLDHPNVVSLKHCFFSTTEKDELYLNLVLEYVPETVHRVIKHYNKLNQRMPLVYVKLYTYQIFRSLSYIHRCIGVCHRDIKPQNLLVNPHTHQVKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPPEAVDLVSRLLQYSPNLRCAALDSLVHPFFDELRDPNARLPNGRFLPPLFNFKPHELKGVPVEMVAKLVPEHARKQCPWLSL

SEQ ID NO: 1274 - protein, 113 aa, Saccharomyces cerevisiae
GVLALQGAFIEHVRHVEKCIVENRDFYEKKLSVMTVKDKNQLAQCDALIIPGGESTAMSLIAERTGFYDDLYAFVHNPSKVTWGTCAGLIYISQQLSNEAKLVKTLNLLKVKV

SEQ ID NO: 1275 - protein, 110 aa, Saccharomyces cerevisiae
VLALQGAFIEHVRHVEKCIVENRDFYEKKLSVMTVKDKNQLAQCDALIIPGGESTAMSLIAERTGFYDDLYAFVHNPSKVTWGTCAGLIYISQQLSNEAKLVKTLNLLKV

SEQ ID NO: 1276 - protein, 591 aa, Saccharomyces cerevisiae
MSHKQFKSDGNIVTPYLLGLARSNPGLTVIKHDRVVFRTASAPNSGNPPKVSLVSGGGSGHEPTHAGFVGEGALDAIAAGAIFASPSTKQIYSAIKAVESPKGTLIIVKNYTGDIIHFGLAAERAKAAGMKVELVAVGDDVSVGKKKGSLVGRRGLGATVLVHKIAGAAASHGLELAEVAEVAQSVVDNSVTIAASLDHCTVPGHKPEAILGENEYEIGMGIHNESGTYKSSPLPSISELVSQMLPLLLDEDEDRSYVKFEPKEDVVLMVNNMGGMSNLELGYAAEVISEQLIDKYQIVPKRTITGAFITALNGPGFGITLMNASKAGGDILKYFDYPTTASGWNQMYHSAKDWEVLAKGQVPTAPSLKTLRNEKGSGVKADYDTFAKILLAGIAKINEVEPKVTWYDTIAGDGDCGTTLVSGGEALEEAIKNHTLRLEDAALGIEDIAYMVEDSMGGTSGGLYSIYLSALAQGVRDSGDKELTAETFKKASNVALDALYKYTRARPGYRTLIDALQPFVEALKAGKGPRAAAQAAYDGAEKTRKMDALVGRASYVAKEELRKLDSEGGLPDPGAVGLAALLDGFVTAAGY

SEQ ID NO: 1277 - protein, 385 aa, Saccharomyces cerevisiae
MTKSVDTLLIPGPIILSGAVQKALDVPSLGHTSPEFVSIFQRVLKNTRAVFKSAAASKSQPFVLAGSGTLGWDIFASNFILSKAPNKNVLVVSTGTFSDRFADCLRSYGAQVDVVRPLKIGESVPLELITEKLSQNSYGAVTVTHVDTSTAVLSDLKAISQAIKQTSPETFFVVDAVCSIGCEEFEFDEWGVDFALTASQKAIGAPAGLSISLCSSRFMDYALNDSKNGHVHGYFSSLRRWTPIMENYEAGKGAYFATPPVQLINSLDVALKEILEEGLHKRWDLHREMSDWFKDSLVNGLQLTSVSRYPSNMSAHGLTAVYVADPPDVIAFLKSHGVVIAGGIHKDIGPKYIRIGHMGVTACNKNLPYMKNCFDLIKLALQRKK

SEQ ID NO: 1278 - protein, 295 aa, Saccharomyces cerevisiae
MPVYEHLLPVNGAWRQDVTNWLSEDVPSFDFGGYVVGSDLKEANLYCKQDGMLCGVPFAQEVFNQCELQVEWLFKEGSFLEPSKNDSGKIVVAKITGPAKNILLAERTALNILSRSSGIATASHKIISLARSTGYKGTIAGTRKTTPGLRRLEKYSMLVGGCDTHRYDLSSMVMLKDNHIWATGSITNAVKNARAVCGFAVKIEVECLSEDEATEAIEAGADVIMLDNFKGDGLKMCAQSLKNKWNGKKHFLLECSGGLNLDNLEEYLCDDIDIYSTSSIHQGTPVIDFSLKLAH

SEQ ID NO: 1279 - protein, 455 aa, Gallus gallus
MLCLMLCVLCWSRSDVAALGSVVENEDALLRHLFQGYQKWVRPVENSNDTIKVLFGLKISQLVDVDEKNQLMTTNVWLKQEWMDHKLSWNPEEYGGITAIRVPSESLWLPDIVLFENADGRFEGSLMTKAIVKYNGVVQWMPPASYKSSCTMELTFFPFDRQNCSMKFGSWTYDGSMVDLILVDENVDTKDFFDNGEWEILNAKGMKGNRKDGLYSYPFVTYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSATYHPMAPWVKRLFLQKLPRLLCMKGHVDRYSFSDTEEKETTLKSKLPGKQKHKQAKDGEKVVIAFLEKAADSIRYISRHVKKDAFIRQVVQDWKFVAQVLDRIFLWLFLVVSVTGSVLIFTPALQMWLNSTL

SEQ ID NO: 1280 - protein, 82 aa, Gallus gallus
KVIPLIGEYLLFIMIFVTLSIIVTVFVINVHHRSSATYHPMAPWVKRLFLQKLPRLLCMKGHVDRYSFSDTEEKETTLKSKL

SEQ ID NO: 1281 - protein, 107 aa, Gallus gallus
VIPLIGEYLLFIMIFVTLSIIVTVFVINVHHRSSATYHPMAPWVKRLFLQKLPRLLCMKGHVDRYSFSDTEEKETTLKSKLPGKQKHKQAKDGEKVVIAFLEKAADS

SEQ ID NO: 1282 - protein, 367 aa, Xenopus laevis
MSGTLARIAEIEAEMARTQKNKATAYHLGLLKARLAKLRRELITPKGGGGGGPGEGFDVAKTGDARIGFVGFPSVGKSTLLSNLAGVYSEVAAYEFTTLTTVPGVVRYKGAKIQLLDLPGIIEGAKDGKGRGRQVIAVARTCNLILIVLDVLKPLGHKKIIENELEGFGIRLNKQPPNIGFKKKDKGGINLTATCAQSELDNDTVKSILAEYKIHNADITLRSDATADDLIDVVEGNRVYIPCIYVLNKIDQISIEELDIIYKVPHCVPISAHHRWNFDDLLEKIWDYLQLVRIYTKPKGQLPDYTSPVVLPCSHTAAEDFCTKIHKNLIKEFKYALVWGSSVKHNPQKVGKDHVLEDEDVIQIVKK

SEQ ID NO: 1283 - protein, 349 aa, Haemophilus influenzae
MKLTKLALCTLFGLGVSIANAADLPNITILATGGTIAGSGQSSVNSAYKAGQLSIDTLIEAVPEMKNIANIKGEQIVKIGSQDMNDEVWLKLAKAINAQCKSTDGFVITHGTDTMEETAYFLDLTVKCEKPVVLVGAMRPATEKSADGPLNLYNAVVVAADKKSSGRGVLVAMNNEVLGARDVTKTSTTAVQTFHSPNYGSLGYIHNSKVDYERSPESKHTINTPFNVEKLDSLPKVGIIYAYSNAPVEPLNALLNAGYQGIVSAGVGNGNVNAAHLDRLEKAAKDSVVVVRSSRVPTGYTTRDAEVDDSKYGFVASGTLNPQKARVLLQLALTQTKDPKVIQQYFEDF

SEQ ID NO: 1284 - protein, 321 aa, Haemophilus influenzae
MIDFRPFYQQIATTNLSDWLETLPCQLKEWETQTHGDYAKWSKIVDFLPNLHADEIDLKSAVKSDRTSPLSEGEKQRIIHHLKQLMPWRKGPYHLFGIHVDCEWRSDFKWDRVLPHLSPLQGRTILDVGCGSGYHMWRMVGEGAKMVVGIDPTELFLCQFEAVRKLLNNDRRANLIPLGIEQMQPLAAFDTVFSMGVLYHRKSPLDHLSQLKNQLVKGGELVLETLVVDGDINTVLVPADRYAKMKNVYFIPSVATLINWLEKVGFTNVRCVDVATTTLEEQRKTDWLENESLIDFLDPNDHSKTIEGYQAPKRAVILANK

SEQ ID NO: 1285 - protein, 351 aa, Haemophilus influenzae
MKLKSLLIACLLSSLSFSALADRIITDQLDRKVTIPDHINRAVVLQHQTLNIAVQLDATKQIVGVLSNWKKQLGKNYVRLAPELENMAMPGDLNSVNIESLLALKPDVVFVTNYAPSEMIKQISDVNIPVVAISLRTGEVGEKGKLNPTLTDEDKAYNDGLKQGIELIAEVFEKKQQGDELVKAAFANRKLLADRLGDVSADKRVRTYMANPDLGTYGSGKYTGLMMEHAGAYNVAAATIKGFKQVSLENVLEWNPAVILVQDRYPDVVPQILNDQGWANIQALKDKKVFLMPEYAKAWGYPMPEALALGEVWLAKALYPQRFQDVDLDKMVNDYYQKFYRTSYKPDNAAR

SEQ ID NO: 1286 - protein, 314 aa, Haemophilus influenzae
MKTIIRYFSFVMGLMLTLPSFAKEKISIMLDWYVNPDHAAIIVAQQKGFFEKNNLEVEIIEPADPALPPKLAAAEKVDLAVSYQPQLYQQVAEGLPLVRVGSLISNPLNSVVVLKKSNLKSLADLKGKKVGYSVSGFEDGLLDTMLHSIGLSNKDVELVNVNWSLSPSLLTGQVDAVIGAFRNFELNQLALEKQEGIAFFPEQYGVPAYDELILVANKNSVTDKKTSAFLTALEQATSYLQAHPNEAWQAFVSYKPNELNTPLNQLAWKDTLPFLANKPRQLDAKRYQQMAEFMQQKGLIPKALALKEYAVEIE

SEQ ID NO: 1287 - protein, 371 aa, Haemophilus influenzae
MKNVGFIGWRGMVGSVLMDRMSQENDFENLNPVFFTTSQAGQKAPVFGGKDAGDLKSAFDIEELKKLDIIVTCQGGDYTNEVYPKLKATGWDGYWVDAASALRMKDDAIIVLDPVNQHVISEGLKKGIKTFVGGNCTVSLMLMAIGGLFEKDLVEWISVATYQAASGAGAKNMRELLSQMGLLEQAVSSELKDPASSILDIERKVTAKMRADNFPTDNFGAALGGSLIPWIDKLLPETGQTKEEWKGYAETNKILGLSDNPIPVDGLCVRIGALRCHSQAFTIKLKKDLPLEEIEQIIASHNEWVKVIPNDKEITLRELTPAKVTGTLSVPVGRLRKLAMGPEYLAAFTVGDQLLWGAAEPVRRILKQLVA

SEQ ID NO: 1288 - protein, 144 aa, Haemophilus influenzae
MIALIQRVSQAKVDVKGETIGKIGKGLLVLLGVEKEDNREKADKLAEKVLNYRIFSDENDKMNLNVQQAQGELLIVSQFTLAADTQKGLRPSFSKGASPALANELYEYFIQKCAEKLPVSTGQFAADMQVSLTNDGPVTFWLNV

SEQ ID NO: 1289 - protein, 141 aa, Haemophilus influenzae
MYKHILVAVDLSEESPILLKKAVGIAKRHDAKLSIIHVDVNFSDLYTGLIDVNMSSMQDRISTETQKALLDLAESVDYPISEKLSGSGDLGQVLSDAIEQYDVDLLVTGHHQDFWSKLMSSTRQVMNTIKIDMLVVPLRDE

SEQ ID NO: 1290 - protein, 328 aa, Haemophilus influenzae
MKLFNFKKLSMLIAGFTLVTSPALAEISLRFGYEAPRSDSQHSAAKKFNDLLMKKTKGEIKLKLFPDSTLGNAQTMISSVRGGTIDLEMSGSPNFTGLEPKLNVIDIPFIFKDREHVYKVLDGEVGQNLLKDLEKQGLKGLAFWDVGFRAFSNSKQTVTKPEHIKGLKVRTNQNPMYIEAFKLLGSNPVPMPLAELYTALETRAVDAQEHPIGIFWSSKLYEVQKYLSLTNHGYTPLIVVMNKAKFDSLLPALQTAIIEAAKEAGQFQRDLNVKNEQNIISKLRKQGVEVIEKINTEPFKTLIEEKVRKSFIEKHGDDLLKKVDALSE

SEQ ID NO: 1291 - protein, 229 aa, Haemophilus influenzae
MKKIFTALLCVAAANAMADDAAIKRKLQSFNISNIVIKSSPISGIKTAVTDQGILYVSEDGKYLFEGKLYELTNNGPVDVAGKILVDKLNSYKDEMIVYPAKNEKHVVTVFMDITCHYCHLLHQQLKEYNDLGITVRYLAFPRAGMNNQTAKQMEAIWTAKDPVFALNEAEKGNLPKEVKTPNIVKKHYELGIQFGVRGTPSIVTSTGELIGGYLKPADLLRALEETAQ

SEQ ID NO: 1292 - protein, 158 aa, Haemophilus influenzae
MTPAIDLLKKQKIPFILHTYDHDPNNQHFGDEAAEKLGIDPNRSFKTLLVAENGDQKKLACFVLATANMLNLKKAAKSIGVKKVEMADKDAAQKSTGYLVGGISPLGQKKRVKTVINSTALEFETIYVSGGKRGLSVEIAPQDLAKVLGAEFTDIVDE

SEQ ID NO: 1293 - protein, 315 aa, Haemophilus influenzae
MKIVFLDSTAIPKHISIPRPSFEHTWTEYEHTSAEQTIERVKDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKDLINAETLSKMKKGAFLINTGRGPLIDELALVDALKTGHLGGAALDVMVKEPPEKDNPLILAAKTMPNLIITPHIAWASDSAVTTLVGKVMQNIEEFVQQLHQK

SEQ ID NO: 1294 - protein, 316 aa, Mus musculus
MASHLELNNGTKMPTLGLGTWKSPPGQVTEAVKVAIDLGYRHIDCAQVYQNEKEVGVALQEKLKEQVVKRQDLFIVSKLWCTFHDKSMVKGAFQKTLSDLQLDYLDLYLIHWPTGFKPGPDYFPLDASGNVIPSDTDFVDTWTAMEQLVDEGLVKTIGVSNFNPLQIERILNKPGLKYKPAVNQIECHPYLTQEKLIEYCHSKGIVVTAYSPLGSPDRPWAKPEDPSLLEDPRIKAIAAKYNKTTAQVLIRFPIQRNLVVIPKSVTPVRIAENLKVFDFEVSSEDMATLLSYNRNWRVCALMSCAKHKDYPFHAEV

SEQ ID NO: 1295 - protein, 964 aa, Drosophila melanogaster
MTSQVPCYTIINSPDLEVTNEMQLKRDLEKGDTNVKIETLKRVIKLLLNGERYPGLIMTIIRFVLPVQNHTIKKLLLIFWEIVPKTSADGKLLQEMILVCDAYRKDLQHPNEFLRGSTLRFLCKLKEPELLEPLMPAIRACLDHRHSYVRRNAVLAIFTIYKNFDWLVPDGPELIASFLDTQQDMSCKRNAFLMLLHADQERALNYLASCIDQVHTFGDILQLVIVELIYKVCHANPAERSRFIRCIYNLLNSSSNAVRYESAGTLITLSLAPTAIKAAASCYIELVVKESDNNVKLIVLDRLVAMKEHEGMEKVMQDLVMDVLRVLAAPDIEVRRKTLALALDLVYSRNIGEMVLVLKKEVAKTHNVEHEDTGKYRQLLVRTLHTCSIKFPDVAANVIPVLVEFLSDTNELAAADVLIFIREAIQKFPALRALIIEHLIEAFPQIKSSKIHRAAVWILGEYVEGSQILEVIAVIQQTLGEVPMVEAEQRRLAGDQTEEQKQQQGSAGGNAAGSAAEGSGSGNASNKVTSDGTYATQSAYSLAPVAKAEKRPPLRQYLMDGDFFIGAALSATLTKLALRYAELETEARAQNRLTTQVMLIMSSILHLGKSGFPSKPITNDDTDRIFVCLRTLSERTPEAISVFTLYCREALGKMLDAQHDEDQRMLKEKQKATAKVQPDDPVLFAQLSNGRDNQLGENVFESSLNQALAGSKNAQLSDVASPNSKLNKVTQLTGFSDPVYAEAYVNVNQYDIVLDVLIVNQTNDTLQNCTLELATLGDLKLVERPHPVVLAPHDFCNIKANVKVSSTENGIIFGNIVYETALNTNVVVLNTIHIDIMDYIIPASCTDTEFRQMWQDFEWENKVTVNTSFTDLHEYLKHLLKSTNMKCLTPEKALSGQCGFMAANMYAKSIFGENALANLSIEKPVDDPDSKVTGHIRIRAKSQGMALSLGDKISSSQKQSVQAA

SEQ ID NO: 1296 - protein, 365 aa, Citrobacter freundii
MLKVIQSPAKYLQGPDASTLFGQYAKNLADSFFVIADDFVMKLAGEKVLNGLHSHDISCHAERFNGECSHIEINRLIAILKQHGCRGVVGIGGGKTLDTAKAIGYYQKLPVVVIPTIASTDAPTSALSVIYTEAGEFEEYLIYPKNPDMVVMDTAIIAKAPVRLLVAGMGDALSTWFEAKACYDARATSMAGGQSTVAALSLARLCYDTLLAEGEKARFAAQAGVVTDALERIVEANTYLSGIGFESSGLAGAHAIHNGFTILEECHHLYHGEKVAFGTLAQLVLQNSPMEEIETVLNFCQKVGLPVTLAEMGVKDDIDGKIMAVAKATCAEGETIHNMPFSVTPESVHAAILTADLLGQQWLAR

SEQ ID NO: 1297 - protein, 154 aa, Mycoplasma capricolum
MWFFNKNLKVLAPCDGTIITLDEVEDEVFKERMLGDGFAINPKSNDFHAPVSGKLVTAFPTKHAFGIQTKSGVEILLHIGLDTVSLDGNGFESFVTQDQEVNAGDKLVTVDLKSVAKKVPSIKSPIIFTNNGGKTLEIVKMGEVKQGDVVAILK

SEQ ID NO: 1298 - protein, 142 aa, Trematomus newnesi
SLSTKDKETVKAFWSKVSGKTEDIGNDALSRMLVVYPQTKIYFSHWKELTPGSAPVRKHGMTVMKGVGDAVSKIEDLTAGLTELSELHAFTLRVDPGNFKILSHNILVVFAIMFPNDFTPQVHVSMDKFLAALSRALSEKYR

SEQ ID NO: 1299 - protein, 110 aa, Saccharomyces cerevisiae
MFILVSVVNICTYIHLHMFPLISTFTSIGLGVLMKDKGKEGKTIKAQNVTYQTFEKYVESSSFFFLVHNFLNSSTMKTLLLMSNNNSISEIPSFSVLKILWKNGIYIAHI

SEQ ID NO: 1300 - protein, 394 aa, Drosophila melanogaster
MDSKGRNVIVCDNGTGFVKCGYAGSNFPTHIFPSMVGRPMIRAVNKIGDIEVKDLMVGDEASQLRSLLEVSYPMENGVVRNWDDMCHVWDYTFGPKKMDIDPTNTKILLTEPPMNPTKNREKMIEVMFEKYGFDSAYIAIQAVLTLYAQGLISGVVIDSGDGVTHICPVYEEFALPHLTRRLDIAGRDITRYLIKLLLLRGYAFNHSADFETVRIMKEKLCYIGYDIEMEQRLALETTVLVESYTLPDGRVIKVGGERFEAPEALFQPHLINVEGPGIAELAFNTIQAADIDIRPELYKHIVLSGGSTMYPGLPSRLEREIKQLYLERVLKNDTEKLAKFKIRIEDPPRRKDMVFIGGAVLAEVTKDRDGFWMSKQEYQEQGLKVLQKLQKISH

SEQ ID NO: 1301 - protein, 589 aa, Caenorhabditis elegans [sequence omitted]

SEQ ID NO: 1302 - protein, 365 aa, Mesembryanthemum crystallinum
MTTYTNGNYTQPKTLDKDEQLAGLAVTLANAAAFPMILKSAFELKILDIFSKAGEGVFVSTSEIASQIGAKNPNAPVLLDRMLRLLASHSVLTCKLQKGEGGSQRVYGPAPLCNYLASNDGQGSLGPLLVLHHDKVMMESWFHLNDYILEGGVPFKRAHGMIQFDYTGTDERFNHVFNQGMAHHTILVMKKLLDNYNGFNDVKVLVDVGGNIGVNVSMIVAKHTHIKGINYDLPHVIADAPSYPGVEHVGGNMFESIPQADAIFMKWVLHDWSDEHCVKILNKCYESLAKGGKIILVESLIPVIPEDNLESHMVFSLDCHTLVHNQGGKERSKEDFEALASKTGFSTVDVICCAYDTWVMELYKK

SEQ ID NO: 1303 - protein, 305 aa, Escherichia coli
MLLAGSSLLTLLDDIATLLDDISVMGKLAAKKTAGVLGDDLSLNAQQVSGVRANRELPVVWGVAKGSLINKVILVPLALIISAFIPWAITPLLMIGGAFLCFEGVEKVLHMLEARKHKEDPAQSQQRLEKLAAQDPLKFEKDKIKGAIRTDFILSAEIVAITLGIVAEAPLLNQVLVLSGIALVVTVGVYGLVGVIVKIDDLGYWLAEKSSALMQALGKGLLIIAPWLMKALSIVGTLAMFLVGGGIVVHGIAPLHHAIEHFAGQQSAVVAMILPTVLNLILGFIIGGIVVLGVKAVEKMRGQAH

SEQ ID NO: 1304 - protein, 459 aa, Bos taurus
MSHGRMNLALSLVFILCGLFNSIFCEKQQHSQKHMNLVLLKKISALSQKMEAHPKDFAQELFKALIIEDPRKNIIFSPMAMTTTLATLSLGIKSTMRTHHPEDLKLEPKLLDVHKYLQPLVHVGRELVKQKVLKHQHILFINRKMMVNQMLLQQISKLQGMDIQMIDFTDIEKAKKTISHHVAEKTHTKITNLITDLNPETILCLVNHIFFKGILKRAFQPKLTQKEVFFVNDQTKVQVDMMRKTERMLYSRSEELHATMVKMPCKGNVSLTLMLPDAGQFDTDLKKMTAKRAKLQKISDFRLVRLILPKLKISFKINFKHLLPKIDPKHILTATAISQAITSKAPLPNLEALHQAEIELSEHALTVDTAIHTDNLLKVPVKAKEVPAVVKVPMKAKEVPAVVKVPMNTKEVPVVVKVPMNTKEVPVVVKVNRPFLLFVEDEKTQRDLFVGKVLNPQVE

SEQ ID NO: 1305 - protein, 420 aa, Sus scrofa
MSHGKMPLVLSLVLILCGLFNSISCEKQQTSPKTITPVSFKRIAALSQKMEANYKAFAQELFKTLLIEDPRKNMIFSPVSISISLATLSLGLRSATRTNAIDVLERDLRNLRVWDKHQALQHLVEMLHELEKKKQLKHKDIFFIDRNKKMNQMFLKEIDRVYKVDIQMIDFKDKEKTKKAINQFVADKIDKKAKNLITHLDPQTLLCLVNYVFFKGILERAFQTNLTKKEDFFVNEKTIVQVDMMRKTERMIYSRSEELLATMVKMPCKENASIILVLPDTGKFDFALKEMAAKRARLQKTNELQIGALSCAQDQDHLQDRFKHLLPKIGINDIFTTKAVTWNTTRTSTILEAVHHAVIEVKEDGLTKNAAKDKDFWKVPVDKKEVPVVVKFDRPFFLFVEDEITRRDLFVAKVFNPKTE

SEQ ID NO: 1306 - protein, 442 aa, Bacillus subtilis
MTKGLKIVTIGGGSSYTPELVEGFIKRYDELPVRELWLVDIPEGEEKLNIVGTLAKRMVEKAGVPIDIHLTLDRRKALKDADFVTTQFRVGLLQARAKDERIPLKYGVIGQETNGPGGLFKGLRTIPVILEIAKDIEELCPNAWLVNFTNPAGMVTEALLRYSNLKKVVGLCNVPIGIKMGVAKALDVDVDRVEVQFAGLNHMVFGLDVFLDGVSVKEQVIEAMGDPKNAMTMKNISGAEWEPDFLKALNVIPCGYHRYYFKTKEMLEHELEASQTEGTRAEVVQKVEKELFELYKDPNLAIKPPQLEKRGGAYYSDAACNLISSIYNDKHDIQPVNTINNGAIASIPDDSAVEVNCVMTKTGPKPIAVGDLPVSVRGLVQQIKSFERVAAEAAVTGDYQTALLAMTINPLVPSDTVAKQILDEMLEAHKAYLPQFFNKIEA

SEQ ID NO: 1307 - protein, 379 aa, Drosophila melanogaster
MSATEGKVITCKAAVAWEAKKPLVIEDIEVAPPKAHEVRIKITATGVCHTDAFTLSGADPEGLFPVVLGHEGAGIVESVGEGVTNFKAGDHVIALYIPQCNECKFCKSGKTNLCQKIRLTQGAGVMPEGTSRLSCKGQQLFHFMGTSTFAEYTVVADISLTKINEKAPLEKVCLLGCGISTGYGAALNTAKVEAGSTCAVWGLGAVGLAVGLGCKKAGAGKIYGIDINPDKFELAKKFGFTDFVNPKDVADKGSIQNYLIDLTDGGFDYTFECIGNVNTMRSALEATHKGWGTSVVIGVAGAGQEISTRPFQLVVGRVWKGSAFGGWRSVSDVPKLVEDYLKKDLLVDEFITHELPLSQINEAFDLMHKGESIRSIIKY

SEQ ID NO: 1308 - protein, 212 aa, Hyoscyamus muticus
MGMKLHGPAMSPAVMRVIATLKEKDLDFELVPVNMQAGDHKKEPFITLNPFGQVPAFEDGDLKLFESRAITQYIAHTYADKGNQLLANDPKKMAIMSVWMEVESQKFDPVASKLTFEIVIKPMLGMVTDDAAVAENEEKLGKVLDVYESRLKDSKYLGGDSFTLADLHHAPAMNYLMGTKVKSLFDSRPHVSAWCADILARPAWSKAIEYKQ

SEQ ID NO: 1309 - protein, 213 aa, Nicotiana tabacum
MAIKVHGSPMSTATMRVAACLIEKDLDFELVPVDMVSGEHKKHPYLSLNPFGQVPAFEDGDLKLFESRAITQYIAHVYADNGYQLILQDPKKMPIMSVWMEVEGQKFEPHASKLTWELGIKPIIGMTTDDDAVKESEVQLSKVLDIYETRLAESKYLGGDSFTLVDLHHIPNIYYLMSTKVKEVFDSRPRVSAWCADILARPAWVKGLEKLQK

SEQ ID NO: 1310 - protein, 366 aa, Eucalyptus gunnii
MGSTGSETQMTPTQVSDEEANLFAMQLASASVLPMVLKAAIELDLLEIMAKAGPGAFLSPGEVAAQLPTQNPEAPVMLDRIFRLLASYSVLTCTLRNLPDGKVERLYGLAPVCKFLVKNEDGVSIAALNLMNQDKILMESWYYLKDAVLEGGIPFNKAYGMTAFEYHGTDPRFNKIFNRGMSDHSTITMKKILETYKGFEGLETVVDVGGGTGAVLSMIVAKYPSMKGINFDLPHVIEDAPPLPGVKHVGGDMFVSVPKGDAIFMKWICHDWSDDHCAKFLKNCYDALPNIGKVIVAECVLPVYPDTSLATKNVIHIDCIMLAHNPGGKERTQKEFETLAKGAGFQGFQVMCCAFGTHVMEFLKTA

SEQ ID NO: 1311 - protein, 190 aa, Flaveria linearis
NPTLYGELAKGQSPKFLVFACSDSRVCPSHILDFQPGEAFVVRNIANMVPPYDTIKHSGAGAAIEYAVLHLKVENIVVIGHSCCGGIKGLMSIPDDGTPASDFIEQWVKLGLPAKSKVKANCNNLEFADLCTKCEKEAVNVSLGNLLTYPFVRDALVNKKLSLKGAHYDFVNGAFDLWNLDFGISPSLLQ

SEQ ID NO: 1312 - protein, 107 aa, Caenorhabditis elegans
KKVNLKFQLSNDKLWHRSLEGKCAFVILTMSCYWVAEVVPLAVTSFIPMIALPFLGIVSIKEVAPKYFADTNIVFFNSLMLSLAVEECQLHKRIALKMLTYVGTRPH

SEQ ID NO: 1313 - protein, 119 aa, Caenorhabditis elegans
TFDIDQKGFYFEKKVNLKFQLSNDKLWHRSLEGKCAFVILTMSCYWVAEVVPLAVTSFIPMIALPFLGIVSIKEVAPKYFADTNIVFFNSLMLSLAVEECQLHKRIALKMLTYVGTRPH

SEQ ID NO: 1314 - protein, 366 aa, Caenorhabditis elegans
MATVGGAFKDSLTQAQKDELHQIALKIVQDGKGILAADESTGTIGKRLDAINLENNETNRQKYRQLLFTTPNLNQHISGVILYEETFHQSTDKGEKFTDLLIKQGIVPGIKLDLGVVPLAGTIGEGTTQGLDKLAERAAAFKKGGCGFAKWRCVLNIGTHTPSHLGMLENANVLARYASICQANGLVPIVEPEVLCDGEHDLARAQKVTEQVLAFVYKALADHHVYLEGTLLKPNMVTPGQSSASKASHEAIGLATVTALRRGVPAAVPGITFLSGGQSELDATANLNAINSVQLGKPWKLTFSYGRALQASVLKAWGGKDENIAAAQKTLLHRSKANGDASLGKYAGEDAAGAAAESLFVAKHSY

SEQ ID NO: 1315 - protein, 65 aa, Mus musculus
RCGWLDLVSLKYAHMINGFTALALTKLDILDMFTEIKVGVAYKLDGETIPHFPANQEVLNKVEVQ

SEQ ID NO: 1316 - protein, 63 aa, Mus musculus
CGWLDLVSLKYAHMINGFTALALTKLDILDMFTEIKVGVAYKLDGETIPHFPANQEVLNKVEV

SEQ ID NO: 1317 - protein, 170 aa, Saccharomyces cerevisiae
EALVRTVTMTENQGNKEMLLQAIHFLSILDQTLFLPYTKKFYVFPKDPIVASIWKIQILSTLINESNVKEIFKELKYYVASAHFPENVVIMAVKSLSRCGQLSTSWESHVMKWLIDHMESHNLSASVLDAYVNVIRMLVQKNPTKHLRIIFKLADLLTVQTSLADNARAG

SEQ ID NO: 1318 - protein, 157 aa, Saccharomyces cerevisiae
LVRTVTMTENQGNKEMLLQAIHFLSILDQTLFLPYTKKFYVFPKDPIVASIWKIQILSTLINESNVKEIFKELKYYVASAHFPENVVIMAVKSLSRCGQLSTSWESHVMKWLIDHMESHNLSASVLDAYVNVIRMLVQKNPTKHLRIIFKLADLLTV

SEQ ID NO: 1319 - protein, 159 aa, Rattus norvegicus
KAQHPNIVTVREIVVGSNMDKIYIVMNYVEHDLKSLMETMKQPFLPGEVKTLMIQLLSGVKHLHDNWILHRDLKTSNLLLTHAGILKVGDFGLAREYGSPLKAYTPVVVTLWYRAPELLLGAKEYSTACDMWSVGCIFGELLTQKPLFPGKSDIDQINK

SEQ ID NO: 1320 - protein, 168 aa, Rattus norvegicus
VEEFQCLNRIEEGTYGVVYRAKDKKTDEIVALKRLKMEKEKEGFPLTSIREINTILKAQHPNIVTVREIVVGSNMDKIYIVMNYVEHDLKSLMETMKQPFLPGEVKTLMIQLLSGVKHLHDNWILHRDLKTSNLLLTHAGILKVGDFGLAREYGSPLKAYTPVVVTLW

SEQ ID NO: 1321 - protein, 311 aa, Saccharomyces cerevisiae
MAVQQRKKKEGRKSDKNAPSVPQVDASLDKPLDIDAPPTIYSVNLKPEYGTAALNLSADFIRQEQALANKYLFFHPVILVVLTIGLLIYLTPRIVFPIRNTGSVAGWFYQLARINKKVVLSGLVFTAIGASFLFTLLSRVSDSYFKSKINQLVGSKGEKVFGINLNDLVARHETKDPVVNNTHIIVYRETPIALISLAPNMTLSTDENLVMSVTTVGCRRVYVKSGIIEDLIDWAMLHSKNIRSSGKYGETMKLLIDVYSFDSTLKEILKKKGFTYIQSIRVSENRLLGGLFGVKKELWGLQFHFKAEHKD

SEQ ID NO: 1322 - protein, 107 aa, Saccharomyces cerevisiae
QLIDYDDKFLNITIDSMLALPEERLIQMCYHGVFSHVVEHVLQTTRVDIIKRKMLLNILSKESVNLACNVYGSHIMDKLWEFTAKLTLYKERIARALVLETEKVKNS

SEQ ID NO: 1323 - protein, 57 aa, Saccharomyces cerevisiae
FSHVVEHVLQTTRVDIIKRKMLLNILSKESVNLACNVYGSHIMDKLWEFTAKLTLYK

SEQ ID NO: 1324 - protein, 108 aa, Saccharomyces cerevisiae
MIQPSKFENLIAIYDIIFCCLQVYLLCKYKDANKSVFLVPVTWPWALRCSWTTRLLCHDNLVNGKHSSCSFCSDVNSKLFRCKHVINIFLSDVLYTFIRFAINIHTFI

SEQ ID NO: 1325 - protein, 136 aa, Saccharomyces cerevisiae
DLKHLCLSIGLLSACWGGHAVFPNLKTDMRHPDKFKDCLKTTYKITSVTDIGTAVIGFLMFGNLVKDEITKNVLLTEGYPKFVYGLISALMTIIPIAKTPLNARPIVSVLDVLMNVQHIDEAASAIKRRAAKGLQV

SEQ ID NO: 1326 - protein, 108 aa, Saccharomyces cerevisiae
LLSACWGGHAVFPNLKTDMRHPDKFKDCLKTTYKITSVTDIGTAVIGFLMFGNLVKDEITKNVLLTEGYPKFVYGLISALMTIIPIAKTPLNARPIVSVLDVLMNVQH

SEQ ID NO: 1327 - protein, 340 aa, Saccharomyces cerevisiae
MTAPLVVLGNPLLDFQADVTAEYLAKYSLKENDAILVDAKSGDAKMAIFDELLQMPETKLVAGGAAQNTARGAAYVLGAGQVVYFGSVGKDKFSERLLNENEKAGVKSMYQVQNDIGTGKCAALITGHNRSLVTDLGAANFFTPDHLDKHWDLVEAAKLFYIGGFHLTVSPDAIVKLGQHAKENSKPFVLNFSAPFIPHVFKDALARVLPYATVIIANESEAEAFCDAFQLDCANTDLEAIAQRIVKDSPVEKTVIFTHGVEPTVVVSSKGTSTYPVKPLDSSKIVDTNGAGDAFAGGFMAGLTKGEDLETSIDMGQWLAALSIQEVGPSYPSEKISYSK

SEQ ID NO: 1328 - protein, 106 aa, Mus musculus
LVIGAWNYPFNLTIQPMVGAIAAGNAVVLKPSEVSDHMADLLSTLIPQYMDKDLYPVIKGGVPETTELLKEKFDHIMYTGSTAVGKIVMAAAAKHLTPVTLELGGK

SEQ ID NO: 1329 - protein, 116 aa, Mus musculus
KTRQTQEDDLYIHSEPLGVVLVIGAWNYPFNLTIQPMVGAIAAGNAVVLKPSEVSDHMADLLSTLIPQYMDKDLYPVIKGGVPETTELLKEKFDHIMYTGSTAVGKIVMAAAAKHL

SEQ ID NO: 1330 - protein, 326 aa, Cavia porcellus
MPHSVSAFQAAYIGIEVLIALVSVPGNVLVIWAVKVNQALRDATFCFIASLAVADVAVGALVIPLAILINIGPQTYFHTCLMVACPVLILTQSSILALLAIAVDRYLRVKIPLRYKTVVTPRRAAVAIAGCWILSLVVGLTPMFGWNNLSKIEMAWAANGSVGEPVIKCEFEKVISMEYMVYFNFFVWVLPPLLLMVLIYLEVFYLIRKQLSKKVSASSGDPQKYYGKELKIAKSLALILFLFALSWLPLHILNCITLFCPTCHKPTILTYIAIFLTHGNSAMNPIVYAFRIQKFRVTFLKIWNDHFRCQPEPPIDEDLPEEKVDD

SEQ ID NO: 1331 - protein, 415 aa, Xenopus laevis
MSDHLLRDEHQENVQPRKLLVPVGGRTVLGVLQENHRGPKALKVSKPALQQTQVLSVNHLGVNDENYGKIPARKAASKQPAFTIHVDEPDCATNKRKAVHKKTVQDENLQQLNSVLGSIGTRKPLHPIQIAMETSFGSPMDVSIVDEEQKVVGCNNVADYAKEIHTYLREMEVKCKPKAGYMQKQPDITGNMRAILVDWLVEVGEEYKLQNETLYLAVNYIDRFLSSMSVLRGKLQLVGTAAMLLASKFEEIYPPEVAEFVYITDDTYTKKQVLKMEHLVLKVLSFDLAAPTILQYLNQYFQIHPVSPKVESLSMFLGELSLVDADPFLRYLPSVVAAAAFVIANCTINERTWSDPLVEYTSYTLETLKPCILDLYQTYLSAASHQQQAVREKYKAPKNHAVSLIIPPESMSTFL

SEQ ID NO: 1332 - protein, 626 aa, Mus musculus
MLAFAARTVVKPLGLLKPSSLMKVSGRFKAHQDALPRLPVPPLQQSLDYYLKALQPIVSEEEWAHTKQLVDEFQTSGGVGERLQKGLERRAKKMENWLSEWWLKTAYLQFRQPVVIYSSPGVILPKQDFVDLQGQLRFAAKLIEGVLDFKSMIDNETLPVEFLGGQPLCMNQYYQILSSCRVPGPKQDSVVNFLKSKRPPTHITVVHNYQFFELDVYHSDGTPLTSDQIFVQLEKIWNSSLQSNKEPVGILTSNHRNTWAKAYNNLIKDKVNRESVNSIQKSIFTVCLDKQVPRVSDDVYRNHVAGQMLHGGGSKFNSGNRWFDKTLQFIVAEDGSCGMVYEHAAAEGPPIVALVDHVMEYTKKPELVRSPMVPLPMPKKLRFNITPEIKNDIEKAKQNLSIMIQDLDIMMLTFHHFGKDFPKSEKLSPDAFIQVALQLAYYRIYGQACATYESASLRMFHLGRTDTIRSASIDSLAFVKGMGDSTVPEQQKVELLRKAVQAHRAYTDRAIRGEAFDRHLLGLKLQAIEDLVSMPDIFMDTSYAIAMHFNLSTSQVPAKTDCVMFFGPVVPDGYGICYNPMEAHINFSVSAYNSCAETNAARMAHYLEKALLDMRTLLQNHPRAKL

SEQ ID NO: 1333 - protein, 400 aa, Saccharomyces cerevisiae
MSIIKKIVFKRFNSTLKKTALHDLHVSLGGTMVPYAGYSMPVLYKGQTHIESHNWTRTNAGLFDVSHMLQSKLSGPHSVKFLQRVTPTDFNALPVGSGTLSVLLNPQGGVVDDTIITKENDDNEFYIVTNAGCAERDTEFFHDELQNGSTLDCQWKIIEGRSLLALQGPKAKDVLEPLLSKTAPGKDLKELFFGQRHEFALKDGSLVQIARGGYTGEDGFEISIANEKAVEFAEQLLANPVMKPIGLAARDSLRLEAGMCLYGHELDESITPVEAALNWVISKSRRDLVDQKYWFNGYAKIMDQLNNKTYSKVRVGFKYLKKGPAARNGVKIFLPDAETEVGLVTSGSASPTLNNINIGQAYVQKGYHKKGTKLLVQVRNKFYPIELAKMPLVPTHYYKQ

SEQ ID NO: 1334 - protein, 110 aa, Bos taurus
IFGSDRMTWISPVTLKELLEAKVKYPQAPVVMGNTSVGPDMKFKGIFHPVIISPDRIEELSVVNYTDNGLTLGAAVSLAEVKDILANVTRKLPEEKTQMYHALLKHLETL

SEQ ID NO: 1335 - protein, 114 aa, Bos taurus
IFGSDRMTWISPVTLKELLEAKVKYPQAPVVMGNTSVGPDMKFKGIFHPVIISPDRIEELSVVNYTDNGLTLGAAVSLAEVKDILANVTRKLPEEKTQMYHALLKHLETLAGPQ

SEQ ID NO: 1336 - protein, 995 aa, Caenorhabditis elegans
MSASKLWSCTETVLNGGIKLFLYSSKNTKLRVAIGEVPGPMVHGAVSFVTEADSDDGLPHTLEHLVFMGSKKYPFKGVLDVIANRCLADGTNAWTDTDHTAYTLSTVGSDGFLKVLPVYINHLLTPMLTASQFATEVHHITGEGNDAGVVYSEMQDHESEMESIMDRKTKEVIYPPFNPYAVDTGGRLKNLRESCTLEKVRDYHKKFYHLSNMVVTVCGMVDHDQVLEIMNNVENEHMSTVPDHFPKPFSFALSDIKESTVHRVECPTDDASRGAVEVAWFAHSPSDLETHSSLHVLFDYLSNTSVAPLQKDFILLEDPLASSVSFHIAEGVRCDLRLNFAGVPVEKLDECAPKFFDKTVREHLEEANFDMERMGYLIDQTILNELVKLETNAPKDIMSHIIGHQLFDNEDEELFKKRTNEIDFLKKLKSEPASYWVQLVNKYFTAPSATVIGVPNEELVDKIAEEEEKRIAAQCEKLGKKGLEEAGKSLEAAILENTANHPSAELLDQLIVKDLEAFDRFPVQSLTSNSPSLTPQQSTFLAQFPFHANLHNCPTKFVEIFFLLDSSNLSIEDRSYLFLYTDLLFESPAMIDGVLTSADDVAKHFTKDLIDHSIQVGVSGLYDRFVNLRIKVGADKYPLLAKWAQIFTQGVVFDPSRIHQCAQKLAGEARDRKRDGCTVASTAVASMVYGKNTNCILFDELVLEKLHEKISKDVMKNPEAVLEKLEQVRSALFSNGVNAHFVADVDSIDPKMLSSDLWTWVQADPRFGPGHQFSAEAGENVSLELGKELLIGVGGSESSFIYQTSFLDANWNSEELIPAMIFGQYLSQCEGPLWRAIRGDGLAYGANVFVKPDRKQITLSLYRCAQPAVAYERTRDIIRKIVESGEISKAEFEGAKRSTVFEMMKREGTVSGAAKISILNNFRQTPHPFNIDLCRRIWNLTSEEMVKIGGPPLARLFDEKCFVRSIAVHPSKLNEMKKAFPGSSKIKISDLQFAC

SEQ ID NO: 1337 - protein, 60 aa, Rattus norvegicus
GVEKDHGIKLTSVVFILICCLIILENIFVLLTIWKTKKFHRPMYYFIGNLALSDLLAGVA

SEQ ID NO: 1338 - protein, 28 aa, Rattus norvegicus
VVFILICCLIILENIFVLLTIWKTKKFH

SEQ ID NO: 1339 - protein, 894 aa, Mus musculus
MMCQKFYVVLLHWEFLYVIAALNLAYPISPWKFKLFCGPPNTTDDSFLSPAGAPNNASALKGASEAIVEAKFNSSGIYVPELSKTVFHCCFGNEQGQNCSALTDNTEGKTLASVVKASVFRQLGVNWDIECWMKGDLTLFICHMEPLPKNPFKNYDSKVHLLYDLPEVIDDSPLPPLKDSFQTVQCNCSLRGCECHVPVPRAKLNYALLMYLEITSAGVSFQSPLMSLQPMLVVKPDPPLGLHMEVTDDGNLKISWDSQTMAPFPLQYQVKYLENSTIVREAAEIVSATSLLVDSVLPGSSYEVQVRSKRLDGSGVWSDWSSPQVFTTQDVVYFPPKILTSVGSNASFHCIYKNENQIISSKQIVWWRNLAEKIPEIQYSIVSDRVSKVTFSNLKATRPRGKFTYDAVYCCNEQACHHRYAELYVIDVNINISCETDGYLTKMTCRWSPSTIQSLVGSTVQLRYHRRSLYCPDSPSIHPTSEPKNCVLQRDGFYECVFQPIFLLSGYTMWIRINHSLGSLDSPPTCVLPDSVVKPLPPSNVKAEITVNTGLLKVSWEKPVFPENNLQFQIRYGLSGKEIQWKTHEVFDAKSKSASLLVSDLCAVYVVQVRCRRLDGLGYWSNWSSPAYTLVMDVKVPMRGPEFWRKMDGDVTKKERNVTLLWKPLTKNDSLCSVRRYVVKHRTAHNGTWSEDVGNRTNLTFLWTEPAHTVTVLAVNSLGASLVNFNLTFSWPMSKVSAVESLSAYPLSSSCVILSWTLSPDDYSLLYLVIEWKILNEDDGMKWLRIPSNVKKFYIHDNFIPIEKYQFSLYPVFMEGVGKPKIINGFTKDAIDKQQNDAGLYVIVPIIISSCVLLLGTLLISHQRMKKLFWDDVPNPKNCSWAQGLNFQKRTDTL

SEQ ID NO: 1340 - protein, 892 aa, Mus musculus
MMCQKFYVVLLHWEFLYVIAALNLAYPISPWKFKLFCGPPNTTDDSFLSPAGAPNNASALKGASEAIVEAKFNSSGIYVPELSKTVFHCCFGNEQGQNCSALTDNTEGKTLASVVKASVFRQLGVNWDIECWMKGDLTLFICHMEPLPKNPFKNYDSKVHLLYDLPEVIDDSPLPPLKDSFQTVQCNCSLRGCECHVPVPRAKLNYALLMYLEITSAGVSFQSPLMSLQPMLVVKPDPPLGLHMEVTDDGNLKISWDSQTMAPFPLQYQVKYLENSTIVREAAEIVSATSLLVDSVLPGSSYEVQVRSKRLDGSGVWSDWSSPQVFTTQDVVYFPPKILTSVGSNASFHCIYKNENQIISSKQIVWWRNLAEKIPEIQYSIVSDRVSKVTFSNLKATRPRGKFTYDAVYCCNEQACHHRYAELYVIDVNINISCETDGYLTKMTCRWSPSTIQSLVGSTVQLRYHRRSLYCPDSPSIHPTSEPKNCVLQRDGFYECVFQPIFLLSGYTMWIRINHSLGSLDSPPTCVLPDSVVKPLPPSNVKAEITVNTGLLKVSWEKPVFPENNLQFQIRYGLSGKEIQWKTHEVFDAKSKSASLLVSDLCAVYVVQVRCRRLDGLGYWSNWSSPAYTLVMDVKVPMRGPEFWRKMDGDVTKKERNVTLLWKPLTKNDSLCSVRRYVVKHRTAHNGTWSEDVGNRTNLTFLWTEPAHTVTVLAVNSLGASLVNFNLTFSWPMSKVSAVESLSAYPLSSSCVILSWTLSPDDYSLLYLVIEWKILNEDDGMKWLRIPSNVKKFYIHDNFIPIEKYQFSLYPVFMEGVGKPKIINGFTKDAIDKQQNDAGLYVIVPIIISSCVLLLGTLLISHQRMKKLFWDDVPNPKNCSWAQGLNFQKVTV

SEQ ID NO: 1341 - protein, 389 aa, Camellia sinensis
MVTVEDIRRAQRAEGPATVMAIGTATPPNCVDQSTYPDYYFRITNSEHKAELKEKFKRMCDKSMIKKRYMYLTEEILKENPQVCEYMAPSLDARQDMVVVEVPKLGKEAATKAIKEWGQPKSKITHLVFCTTSGVDMPGADYQLTKLLGLRPSVKRLMMYQQGCFAGGTVLRLAKDLAENNKGARVLVVCSEITAVTFRGPSDTHLDSLVGQALFGDGAAAIIVGSDPIPEVEKPLFELVSAAQTILPDSDGAIDGHLREVGLTFHLLKDVPGLISKNIEKSLAEAFQPLGISDWNSLFWIAHPGGPAILDQVELKLGLKEEKLRATRHVLSEYGNMSSACVLFILDEMRKKSAADGLKTTGEGLEWGVLFGFGPGLTVETVVLHSLST

SEQ ID NO: 1342 - protein, 389 aa, Camellia sinensis
MVTVEEVRRAQRAEGPATVMAIGTATPPNCVDQSTYPDYYFRITNSEHKTELKEKFQRMCDKSMIKKRYMYLTEEILKENPNVCAYMAPSLDARQDMVVVEVPKLGKEAATKAIKEWGQPKSKITHLVFCTTSGVDMPGADYQLTKLLGLRPSVKRLMMYQQGCFAGGTVLRLAKDLAENNKGARVLVVCSEITAVTFRGPSDAHLDSLVGQALFGDGAAAIIVGSDPIPEVEKPLFELVSAAQTILPDSDGAIDGHLREVGLTFHLLKDVPGLISKNIEKSLNEAFQPLNITDWNSLFWIAHPGGPAILDQVELKLALKPEKLRATRHVLSEYGNMSSACVLFILDEMRKSSAKKGLKTTGEGLDWGVLFGFGPGLTVETVVLHSVST

SEQ ID NO: 1343 - protein, 389 aa, Camellia sinensis
MVTVEDVWRAQRARGPATVLAIGTATPPNCVDQSTYPDYYFRITNSEHKVELKEKFKRMCDKSMIKKRYMYLTEEILKENPLVCEYMAPSLDARQDMVVVEVPKLGKEAATKAIKEWGQPKSKITHLVFCTTSGVDMPGADYQLTKLLGLRPSVKRLMMYQQGCFAGGTVLRLAKDLAENNKGARVLVVCSEITAVTFRGPSDTHLDSLVGQSLFGDGAAAIIIGSDPIPEVEKPLFELVSAAQTILPSSDGAIDGHLREVGLTFHLLKDVPRLISMNVEKSLVEAFQPLGISDWNSLFWIAHPGGPAILDQVELKLGLKEEKLRATRHVLSEYGNMSSACVLFILDEMRKKSAEEGLKTTGEGLEWGVLFGFGPGLTVETVVLHSLCT

SEQ ID NO: 1344 - protein, 398 aa, Gerbera hybrida
MASSVDMKAIRDAQRAEGPATILAIGTATPANCVYQADYPDYYFRITKSEHMVDLKEKFKRMCDKSMIRKRYMHITEEYLKQNPNMCAYMAPSLDVRQDLVVVEVPKLGKEAAMKAIKEWGHPKSKITHLIFCTTSGVDMPGADYQLTKLLGLRPSVKRFMMYQQGCFAGGTVLRLAKDLAENNKGARVLVVCSEITAVTFRGPNDTHLDSLVGQALFGDGAAAVIVGSDPDLTTERPLFEMVSAAQTILPDSEGAIDGHLREVGLTFHLLKDVPGLISKNIEKALTTAFSPLGINDWNSIFWIAHPGGPAILDQVELKLGLKEEKLRATRHVLSEYGNMSSACVLFIIDEMRKKSSENGAGTTGEGLEWGVLFGFGPGLTVETVVLHSVPTTVTVAV

SEQ ID NO: 1345 - protein, 402 aa, Gerbera hybrida
MGSYSSDDVEVIREAGRAQGLATILAIGTATPPNCVAQADYADYYFRVTKSEHMVDLKEKFKRICEKTAIKKRYLALTEDYLQENPTMCEFMAPSLNARQDLVVTGVPMLGKEAAVKAIDEWGLPKSKITHLIFCTTAGVDMPGADYQLVKLLGLSPSVKRYMLYQQGCAAGGTVLRLAKDLAENNKGSRVLIVCSEITAILFHGPNENHLDSLVAQALFGDGAAALIVGSGPHLAVERPIFEIVSTDQTILPDTEKAMKLHLREGGLTFQLHRDVPLMVAKNIENAAEKALSPLGITDWNSVFWMVHPGGRAILDQVERKLNLKEDKLRASRHVLSEYGNLISACVLFIIDEVRKRSMAEGKSTTGEGLDCGVLFGFGPGMTVETVVLRSVRVTAAVANGN

SEQ ID NO: 1346 - protein, 403 aa, Gerbera hybrida
MATSPAVIDVETIRKAQRAEGPATILAIGTATPANCVYQADYPDYYFRVTESEHMVDLKEKFQRMCDKSMIRKRYMHITEEFLKENPSMCKFMAPSLDARQDLVVVEVPKLGKEAATKAIKEWGFPKSKITHLVFCTTSGVDMPGADYQLTKLLGLRPSVKRLMMYQQGCFAGGTVLRLAKDLAENNKGARVLVVCSEITAVTFRGPNEGHLDSLVGQALFGDGAAAVIIGSDPDLSVERPLFEMVSAAQTILPDSEGAIDGHLKEVGLTFHLLKDVPALIAKNIEKALIQAFSPLNINDWNSIFWIAHPGGPAILDQVEFKLGLREEKLRASRHVLSEYGNMSSACVLFILDEMRKKSIKDGKTTTGEGLEWGVLFGFGPGLTVETVVLHSLPATISVATQN

SEQ ID NO: 1347 - protein, 192 aa, Drosophila melanogaster
MQAIKCVVVGDGAVGKTCLLISYTTNAFPGEYIPTVFDNYSANVMVDAKPINLGLWDTAGQEDYDRLRPLSYPQTDVFLICFSLVNPASFENVRAKWFPEVRHHCPSVPIILVGTKLDLRDDKQTIEKLKDKKLTPITYPQGLAMAKEIAAVKYLECSALTQKGLKTVFDEAIRSVLCPVVRGPKRHKCALL

SEQ ID NO: 1348 - protein, 87 aa, Drosophila melanogaster
QTDVFLICFSLVNPASFENVRAKWFPEVRHHCPSVPIILVGTKLDLRDDKQTIEKLKDKKLTPITYPQGLAMAKEIAAVKYLECSAL

SEQ ID NO: 1349 - protein, 116 aa, Drosophila melanogaster
VFLICFSLVNPASFENVRAKWFPEVRHHCPSVPIILVGTKLDLRDDKQTIEKLKDKKLTPITYPQGLAMAKEIAAVKYLECSALTQKGLKTVFDEAIRSVLCPVVRGPKRHKCALL

SEQ ID NO: 1350 - protein, 298 aa, Mesocricetus auratus
MENFQKVEKIGEGTYGVVYKAKNKLTGEVVALKKIRLDTETEGVPSTAIREISLLKELNHPNIVKLLDVIHTENKLYLVFELLHQDLKKFMDASAVTGIPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 1351 - protein, 60 aa, Drosophila melanogaster
FVKLTLRSGLKVPEGDHIMEPVAYHCICKQKSIPVVQWNNEQSTTMLYQPFVLLLHKLGI

SEQ ID NO: 1352 - protein, 31 aa, Drosophila melanogaster
ICKQKSIPVVQWNNEQSTTMLYQPFVLLLHK

SEQ ID NO: 1353 - protein, 60 aa, Drosophila melanogaster; identical to SEQ ID NO: 1351

SEQ ID NO: 1354 - protein, 31 aa, Drosophila melanogaster; identical to SEQ ID NO: 1352

SEQ ID NO: 1355 - protein, 567 aa, Zea mays
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLAPHIQQLSMESNGKGVSIDGAQLSFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQWGVELGKSLASQVRKQLHGTRMEGKPVEGFNHSTSSLLARYLAVKPSTPYDTTVLPKV

SEQ ID NO: 1356 - protein, 74 aa, Bos taurus
EVYHFKPHLCVALRIPEGVWQLSSCQDKKGFICKMEADIHTVKKHPGKGPSHSVIPLTVALTLLVILAISTLSF

SEQ ID NO: 1357 - protein, 76 aa, Bos taurus
VYHFKPHLCVALRIPEGVWQLSSCQDKKGFICKMEADIHTVKKHPGKGPSHSVIPLTVALTLLVILAISTLSFCMY

SEQ ID NO: 1358 - protein, 496 aa, Thlaspi arvense
MDLLYIVAALVIFASLLIAKSKRKPKKNLPPGPPRLPIIGNLHQLGEKPHRAMVELSKTYGPLMSLKLGSVTTVVATSVETVRDVLKTYDLECCSRPYMTYPARITYNLKDLVFSPYDKYWRQVRKLTVVELYTAKRVQSFRHIREEEVASFVRFNKQAASSEETVNLSQKILKMSGSVICRIGFGINLEGSKLENTYQEIIVQAFEVLGSLAAVDYFPVIGTIIDRITGLHAKCEKVFHGIDSFFDQAIQRHIDDPSIKDDIIDLLLKMERGEGSLGEYELTREHTKGILMNILTAGIDTSAQTMTWAMTHLLANPRVMKKLQAEIREKIKNIDEITDDDVEQLDYFKLVLKETFRISPIVPVLVPRVAAKDLKIAGYDVPEKTWIHVNMWAVHMSPSIWKDPETFNPERFIDNQTDFKGLNFELLPFGSGRRMCPGMGMGLAVVHLTLINLLYRFDWKLPNGMKAEELSIEENYGLICVKKLPLEAIPVLTQWT

SEQ ID NO: 1359 - protein, 123 aa, Artemisia annua
QTASGQMIDLITTLVGEKDLSKYSLSIHRRIVQYKTAYYSFYLPVACALLMFGEDLDKHVEVKNVLVEMGTYFQVQDDYLDCFGAPEVIGKIGTDIEDFKCSWLVVKALELPNEEQKKTLHEN

SEQ ID NO: 1360 - protein, 115 aa, Artemisia annua
MIDLITTLVGEKDLSKYSLSIHRRIVQYKTAYYSFYLPVACALLMFGEDLDKHVEVKNVLVEMGTYFQVQDDYLDCFGAPEVIGKIGTDIEDFKCSWLVVKALELPNEEQKKTLH

SEQ ID NO: 1361 - protein, 693 aa, Saccharomyces cerevisiae
MLRSTTFTRSFHSSRAWLKGQNLTEKIVQSYAVNLPEGKVVHSGDYVSIKPAHCMSHDNSWPVALKFMGLGATKIKNPSQIVTTLDHDIQNKSEKNLTKYKNIENFAKKHHIDHYPAGRGIGHQIMIEEGYAFPLNMTVASDSHSNTYGGLGSLGTPIVRTDAAAIWATGQTWWQIPPVAQVELKGQLPQGVSGKDIIVALCGLFNNDQVLNHAIEFTGDSLNALPIDHRLTIANMTTEWGALSGLFPVDKTLIDWYKNRLQKLGTNNHPRINPKTIRALEEKAKIPKADKDAHYAKKLIIDLATLTHYVSGPNSVKVSNTVQDLSQQDIKINKAYLVSCTNSRLSDLQSAADVVCPTGDLNKVNKVAPGVEFYVAAASSEIEADARKSGAWEKLLKAGCIPLPSGCGPCIGLGAGLLEPGEVGISATNRNFKGRMGSKDALAYLASPAVVAASAVLGKISSPAEVLSTSEIPFSGVKTEIIENPVVEEEVNAQTEAPKQSVEILEGFPREFSGELVLCDADNINTDGIYPGKYTYQDDVPKEKMAQVCMENYDAEFRTKVHPGDIVVSGFNFGTGSSREQAATALLAKGINLVVSGSFGNIFSRNSINNALLTLEIPALIKKLREKYQGAPKELTRRTGWFLKWDVADAKVVVTEGSLDGPVILEQKVGELGKNLQEIIVKGGLEGWVKSQL

SEQ ID NO: 1362 - protein, 389 aa, Phaseolus vulgaris
MVSVSEIRQAQRAEGPATILAIGTATPSNCVDQSTYPDYYFRITNSEHMTDLKEKFQRMCDKSMIKKRYMHLNEEILKENPNMCAYMAPSLDARQDIVVVEVPKLGKEAAVKAIKEWGQPKSKITHLIFCTTSGVDMPGADYQLTKLLGLRPYVKRYMMYQQGCFAGGTVLRLAKDLAENNKGARVLVVCSEITAVTFRGPSDTHLDSLVGQALFGDGAAAVIVGSDPIPQIEKPLFELVWTAQTIAPDSDGAIDGHLREVGLTFHLLKDVPGIVSKNIGKALFEAFNPLNISDYNSIFWIAHPGGPAILDQVEQKLGLKPEKMKATRDVLSDYGNMSGACVLFILDEMRRKSAEKGLKTTGEGLEWGVLFGFGPGLTIETVVLHSVAI

SEQ ID NO: 1363 - protein, 396 aa, Mus musculus
MSDILLELLCVSEKAANIARACRQQETLFQLLIEEKKGAEKNKKFAADFKTLADVLVQEVIKQNMENKFPGLGKKVFGEESNEFTNDLGEKITVELQSTEEETAELLSKVLNGNMPASEALAQVVHEDVDLTDPTLESLDISIPHESLGIWVDPIDSTYQYIKGSANVKSNQGIFPSGLQCVTILIGVYDLQTGLPLMGVINQPFASQNLTTLRWKGQCYWGLSYMGTNIHSLQLAISKSDSETQTENSDREFSSPFSAVISTSEKDTIKAALSRVCGGSVFPAAGAGYKSLCVIQGLADIYIFSEDTTYKWDSCAAHAILRAMGGGIVDMKECLERSPDTGLDLPQLLYHVENKGASGVELWANKGGLIAYRSRNRLDTFLSRLIQNLGPVKTQA

SEQ ID NO: 1364 - protein, 494 aa, Gallus gallus
MHPKRRLCWCLPASGAWAFMLTSLIADTTACESEERLFHKLFSRYNQFIRPVENVSDPVTVHFELAITQLTNVDEVNQIMETNLWLRHIWNDYKLRRDPREYDGIEFVRVPADKIWKPDIVLYNNAVGDFQVEGKTKALLRYDGMITWTPPAIFKSSCPMDITFFPFDHQNCSLKFGSWTYDKAKIDLLIIGSKVDMNEFWENSEWEIVDASGYKHDIKYNCCEEIYTDITYSFYIRRLPMFYTINLIIPCLFISFLTVLVFYLPSDCGEKVTLCISVLLSLTVFLLVITETIPSTSLVIPLVGEYLLFTMIFVTLSIVITVFVLNIHYRTPTTHTMPKWVKTVFLSLLPKVLLMQRPLEQEKKNISKKTKKGSAKTSGKSKHSKHKDNKLHKEQRCCHCDKADDLTSTRRSRLSHQSLKWMAEHTEYSPEVKDVINNVQFIAENMKSQNETKEVEDDWKYVAMVIDRVFLWVFIILCVFGTAGLFIQPLIADT

SEQ ID NO: 1365 - protein, 200 aa, Gallus gallus
VLLSLTVFLLVITETIPSTSLVIPLVGEYLLFTMIFVTLSIVITVFVLNIHYRTPTTHTMPKWVKTVFLSLLPKVLLMQRPLEQEKKNISKKTKKGSAKTSGKSKHSKHKDNKLHKEQRCCHCDKADDLTSTRRSRLSHQSLKWMAEHTEYSPEVKDVINNVQFIAENMKSQNETKEVEDDWKYVAMVIDRVFLWVFIIL

SEQ ID NO: 1366 - protein, 63 aa, Gallus gallus
LLFTMIFVTLSIVITVFVLNIHYRTPTTHTMPKWVKTVFLSLLPKVLLMQRPLEQEKKNISKK

SEQ ID NO: 1367 - protein, 52 aa, Meleagris gallopavo; identical to SEQ ID NO: 1139

SEQ ID NO: 1368 - protein, 94 aa, Meleagris gallopavo; identical to SEQ ID NO: 1140

SEQ ID NO: 1369 - protein, 971 aa, Saccharomyces cerevisiae
MSHPIQFVNANNSDKSHQLGGQYSIPQDLRENLQKEAARIGENEKDVLQEKMETRTVQNREDSYHKRRFDMKFEPDSDTQTVTSSENTQDAVVPRKRKSRWDVKGYEPPDESSTAVKENSDSALVNVEGIHDLMFFKPSDHKYFADVISKKPIDELNKDEKKERTLSMLLLKIKNGNTASRRTSMRILTDKAVTFGPEMIFNRLLPILLDRSLEDQERHLMIKTIDRVLYQLGDLTKPYVHKILVVAAPLLIDEDPMVRSTGQEIITNLSTVAGLKTILTVMRPDIENEDEYVRNVTSRAAAVVAKALGVNQLLPFINAACHSRKSWKARHTGIKIVQQIGILLGIGVLNHLTGLMSCIKDCLMDDHVPVRIVTAHTLSTLAENSYPYGIEVFNVVLEPLWKGIRSHRGKVLSSFLKAVGSMIPLMDPEYAGYYTTEAMRIIRREFDSPDDEMKKTILLVLQKCSAVESITPKFLREEIAPEFFQKFWVRRVALDRPLNKVVTYTTVTLAKKLGCSYTIDKLLTPLRDEAEPFRTMAVHAVTRTVNLLGTADLDERLETRLIDALLIAFQEQTNSDSIIFKGFGAVTVSLDIRMKPFLAPIVSTILNHLKHKTPLVRQHAADLCAILIPVIKNCHEFEMLNKLNIILYESLGEVYPEVLGSIINAMYCITSVMDLDKLQPPINQILPTLTPILRNKHRKVEVNTIKFVGLIGKLAPTYAPPKEWMRICFELLELLKSTNKEIRRSANATFGFIAEAIGPHDVLVALLNNLKVQERQLRVCTAVAIGIVAKVCGPYNVLPVIMNEYTTPETNVQNGVLKAMSFMFEYIGNMSKDYIYFITPLLEDALTDRDLVHRQTASNVITHLALNCSGTGHEDAFIHLMNLLIPNIFETSPHAIMRILEGLEALSQALGPGLFMNYIWAGLFHPAKNVRKAFWRVYNNMYVMYQDAMVPFYPVTPDNNEEYIEELDLVL

SEQ ID NO: 1370 - protein, 485 aa, Phalaenopsis sp.
MALLVEKTTSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLQEYWWCTERCLEWGAGGGPDLIVDDGGDATLLIHEGVKAEEEYEKNGKIPDPASTDNAEFQIVLGLIRDSLSVDPKKYRRMKERLVGVSEETTTGVKRLYQMQYSGTLLFPAINVNDSVTKSKFDNLYGCRHSLPDGLMRATDVMIAGKVAVVCGYGDVGLGCAAALKTAGARVIVTEIDPICALQALMEGLPVLRLEDVVSEADIFVTTTGNKDIIMVDHMRKMKNNAIVCNIGHFDNEIDMLGLESFPGVKRITIKPQTDRRVFPDTNSGILVLAEGRLMNLGCATGHPSFVMSSSFTNQVIAQLELWKERASGKYEKKVYVLPKHLDEKVAALHLGKLGAKLTKLTPSQADYISVPVEGPYKPAHYRY

SEQ ID NO: 1371 - protein, 404 aa, Caenorhabditis elegans
MSQHKFLFTSESVSEGHPDKMCDQISDAVLDAHLAQDPHAKVACETVTKTGMIMLCGEITSKAVVDYQVLVRNVIKKIGYDDSSKGFDYKTCNVLVALEQQSPEIAAGVHVDKDSDDVGAGDQGIMFGYATDETEEAMPLTLLLSHKLNRKLHELRRSGELEWVRPDSKTQVTIEYASEGGACVPLRVHTVVISTQHSPDISLDDLRKELIEKVIKAVIPANLIDDKTIYHLNPCGSFIIGGPMGDAGLTGRKIIVDTYGGWGAHGGGAFSGKDPTKVDRSAAYAARWVAKSLVKSGLCRRCLVQVSYAIGVAKPLSVMVFSFGTSALNEGELLKIVNDNFDLRPGMIIKDLDLKKPIYEPTAENGHFGHNEFPWEQPRHLQIDVELLKKIGGKTISNGNGIAH

SEQ ID NO: 1372 - protein, 415 aa, Opisthorchis sinensis
MGLRKLSIANVDLKDKRVLMRVDFNVPMKDGKVTNTQRIVGASPTIKYALDKGAKSIVLMSHLGGRVGNKVARYSLNPVGEEVSKLLGKPVKFLPDCVGPETTEGMCQSSAGSVFLLENLRFHVEEEGKGVSPTGEKIKATPEQVKAFSENLTKLGDVYLNDAFGTAHRAHASMVGCRLTQRACGFLMDKELTYFSKLLDQPQHPFLAIIGGAKVSDKIQLIKNMLDKVDELIITGGMAFTFLKKLHNMKIGKSLYDEPGAAIVDEWMQLAKSKNVKIHLPVDFITGDKFAEDANTGTATVEPGIRDTHMGLDGGPKTMEEFCKVISRAKTIVWNGPMGVFEMEKFAGGTKAAMDAVVAATTKGVTNNNGGGDTATCCPKWKTEAQVSHVSTGVGASLELLEGKQLPGILALSDA

SEQ ID NO: 1373 - protein, 322 aa, Lupinus luteus
MAPKATKAEKKIVYDGKLCQLLDEYTQILVVNADNVGSKQLQNIRQGLRGDSVVLMGKNTMMKRSVRIHAEKTGNQAFLNLIPLLIGNVGLIFTKGYLKEVSEEVAKYKVGAPACVGLVAPIDVVVPPGNTGLDPSQTSFFQVLNIPTKINKGTVEIITPVELIKKGDKVGSSEAALLAKLGIRPFSYGLVVLSVYDNGSVFKPEVLDLTEDDLLEKFAIGVSQCYFSDTSHFIPNPSAAPHVFINAYKNVLAVAVATEYSFPQADEVKEYLKDPSKFAAVAAAAAPAADSGAAPAAAAKAEKEEEPAEESDDEMGFGLFDE

SEQ ID NO: 1374 - protein, 320 aa, Glycine max
MAPKQTKAEKKIAYDAKLCDLMEEYGQILVVNSDNVGSNQLQNIRKGLRGDSVVLMGKNTMMKRSVRMHAEKTGNNAYLNLIPLLVGNVGLIFTKGDLKEVSEEVAKYKVGAPARVGLVAPIDVVVPPGNTGLDPSQTSFFQVLNIPTKINKGTVEIITPVELIRKGDKVGSSEAALLAKLGIRPFSYGLVVLSVYDNGSVFSPEVLDLTEDDLIGKFAAGVSMVTSLSLAISYPTLAAAPHMFVNAYKNVLAVAVETDYSFPEADKVKEYLKDPSKFAVAAVAAPAAASGAPAAAAKEEEKKEEPAEESDDDMGFSLFD

SEQ ID NO: 1375 - protein, 421 aa, Sus scrofa
MASSSTWGLLLLAGLCCLVPISLAEGLQGHAVQETDVPRHDHEQHQEAACHRIAPNLADFAFSLYRQVARQSNTSNIFLSPVTIARAFAMLSLGTKGATHAEILEGLQFNLTEKAEAEIHEGFQHLLHTLNQPDNQLQLTTGNGLFIDEKAKLVPKFLEDVKNLYHSEAFSINFRDTEEAKKCINDYVEKGSQGKIVDLVDELDKDTVFALVNYIFFKGKWEKPFEVEQTTEEDFHVDEETTVKVPMMNRLGMFDLHHCDKLSSWVLLMDYVATATAFFILPDQGKLHQLEDMLTKEIRAKFLEKRYPSSANLHLPKLTISGTYDLKSLLGNLGITKVFSDEADLSGVTEEQPLKLSKALHRAVLTIDEKGTEATGATILEAIPMSIPPNVKFNKPFLFLIYDTKTKAVLFMGKVMNPTQK

SEQ ID NO: 1376 - protein, 412 aa, Ovis aries
MPLFFSLVLLILGLHCAPPNSCEGKITSCLSPQQNATLYKMSSINADFAFNLYRKVTVETPDQNIFFSPVSISAGLAMLSLGACSSTQTQILESLGFNLTDTPMAEIQQGFQHLICSLNFPKKELELQMGNALFIGKQLKPLEKFLDDVKNLYETEVFSTDFSNVSAAQQEINSHVERQTKGKIVGLIQDLKPNTITVLVNYLCFKAQWANPFDPSKTEEGSSFLVDKTTTVQVPMMHQVDQYYHLVDTELNCTVLQMDYSKNALALFVLPKEGQMEGVEGAMSSKILKKWNRLLQKGWVNLFVPKFSISATYDLGGILLKMGIQDAFADNADFSGLTKDNGLKVSNVAHKAMFYIGEKGTEAIPEVRFLNQPETTLLHPIIQFDRSFLLLILEKNTRSILFLGKVVDPTEV

SEQ ID NO: 1377 - protein, 90 aa, Arachis hypogaea
KEAATKAIKEWGQPMSKITHLIFCTTSGVALPGVDYELIVLLGLDPCVKRYMMYHQGCFAGGTVLRLAKDLAENNKDARVLIVCSENTAV

SEQ ID NO: 1378 - protein, 78 aa, Arachis hypogaea
KAIKEWGQPMSKITHLIFCTTSGVALPGVDYELIVLLGLDPCVKRYMMYHQGCFAGGTVLRLAKDLAENNKDARVLIV

SEQ ID NO: 1379 - protein, 392 aa, Vitis vinifera
MASVEEIRNAQRAKGPATILAIGTATPDHCVYQSDYADYYFRVTKSEHMTALKKKFNRICDKSMIKKRYIHLTEEMLEEHPNIGAYMAPSLNIRQEIITAEVPKLGKEAALKALKEWGQPKSKITHLVFCTTSGVEMPGADYKLANLLGLEPSVRRVMLYHQGCYAGGTVLRTAKDLAENNAGARVLVVCSEITVVTFRGPSEDALDSLVGQALFGDGSAAVIVGSDPDISIERPLFQLVSAAQTFIPNSAGAIAGNLREVGLTFHLWPNVPTLISENIEKCLTQAFDPLGISDWNSLFWIAHPGGPAILDAVEAKLNLDKKKLEATRHVLSEYGNMSSACVLFILDEMRKKSLKGERATTGEGLDWGVLFGFGPGLTIETVVLHSIPMVTN

SEQ ID NO: 1380 - protein, 392 aa, Vitis vinifera
MASVEEIRNAQRAKGPATILAIGTATPDHCVYQSDYADYYFRVTKSEHMTELKKKFNRICDKSMIKKRYIHLTEEMLEEHPNIGAYMAPSLNIRQEIITVEVPKLGKEAALKALKEWGQPKSKITHLVFCTTSGVEMPGADYKLANLLGLETSVRRVMLYHQGCYAGGTVLRTAKDLAENNAGARVLVVCSEITVVTFRGPSEDALDSLVGQALFGDGSAAVIVGSDPDVSIERPLFQLVSAAQTFIPNSAGAIAGNLREVGLTFHLWPNVPTLISENVEKCLTQAFDPLGISDWNSLFWIAHPGGPAILDAVEAKLNLDKKKLEATRHVLSEYGNMSSACVLFILDEMRKKSHKGEKATTGEGLDWGVLFGFGPGLTIETVVLHSIPMVTN

SEQ ID NO: 1381 - protein, 395 aa, Betula pendula
MASVEEIRKAQRAHGPATVLAIGTATPSNCITQADYPDYYFRITKSDHMTELKEKFKRMCDKSMIKKRYMYLNEEILNENPNMCAYMAPSLDARQTIVVVEVPKLGKEAATKAIKEWGQPKSKITHLVFCTTSGVDMPGADYQLTKLLGLRPSVKRLMMYQQGCFAGGTVLRLAKDLAENNKGARVLVVCSEITAVTFRGPTDTHLDSLVGQALFGDGAAAVIVGADPDTSVERPLFELISAAQTILPDSDGAIDGHLREVGLTFHLLKDVPGIISKNIEKSLAEAFAPLGISDWNSLFWIAHPGGPAILDQVESKLGLKEEKLRATRHVLSEYGNMSSACVLFILDEMRRNSLEGGKVTTGEGLEWGVLFGFGPGLTVETVVLHSVPVPVEASH

SEQ ID NO: 1382 - protein, 389 aa, Medicago sativa
MVSVSEIRQAQRAEGPATIMAIGTANPSNCVEQSTYPDFYFKITNSEHKVELKEKFQRMCDKSMIKRRYMYLTEEILKENPSVCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPIPEIEKPIFEMVWTAQTIAPDSEGAIDGHLVEAGLTFHLLKDVPGIVSKNIDKALIEAFQPLNISDYNSIFWIAHPGGPAILDQVEEKLGLKPEKMKATREVLSEYGNMSSACVLFILDEMRKKSAQAGLKTTGEGLDWGVLFGFGPGLTIETVVLHSVAI

SEQ ID NO: 1383 - protein, 389 aa, Medicago sativa
MVSVSEIRNAQRAEGPATTLAIGTANPTNCVEQSTYPDFYFKITNSEHKTELKEKFQRMCDKSMIKRRYMYLTEEILKENPSVCEIMAPSLDAWQDMVVVEVPRLGKEAAVKAIKEWGQPKSKITHLIVCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNINKALVEAFEPLGISDYNSIFWIAHPGGPAILDQVEQKLALKPEKMKATREVLSEYGNMSSACVLFILDEMRKKSAQDGLKTTGEGLEWGVLFGFGPGLTIETVVLRSVAI

SEQ ID NO: 1384 - protein, 285 aa, Medicago sativa
LGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPIPEIEKPIFEMVWTAQTIAPDSEGAIDGHLREAGLTFHLLKDVPGIVSKNIDKALVEAFQPLNISDYNSIFWIAHPGGPAILDQVEQKLGLKPEKMKATREVLSEYGNMSSACVLFILDEMRKKSAQQGLKTTGEGLDWGVLFGFGPGLTIETVVLHSVAL

SEQ ID NO: 1385 - protein, 265 aa, Medicago sativa
ITHLIVCTTSVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNINKALVEAFEPLGISDYNSIFWIAHPGGPAILDQVEQKLALKPEKMKATREVLSEYGNMSSACVLFILDEMRKKSAQDGLKTTGEGLEWGVLFGFGPGLTIETVVLRSVTI

SEQ ID NO: 1386 - protein, 389 aa, Trifolium subterraneum
MVSVSEIRQAQRAEGPATILAIGTANPANKVEQATYPDFYFKITNSEHKVELKEKFQRMCDKSMIKSRYMYLTEEILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFVMVWTAQTIAPDSEGAIDGHLREAGLTFHLLKDVPGIVSKNIDKALVEAFQPLGISDYNSIFWIAHPGGPAILDQVEQKLALKPEKMKATREVLSEYGNMSSACVLFILDEMRKKSTKDGLKTTGEGLDWGVLFGFGPGLTIETVVLHSVAI

SEQ ID NO: 1387 - protein, 311 aa, Trifolium subterraneum
MVSVSEIRKAQRAEGPATILAIGTANPANKVEQATYPDFYFKITNSEHKVELKEKFQRMCDKSMIKSRYMYLTEEILKENPSVCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNIDKALVEAFQPLGISDYNSIFWIAHPGGPAILD

SEQ ID NO: 1388 - protein, 389 aa, Trifolium subterraneum
MVSVAEIRQAQRAEGPATILAIGTANPANKVEQATYPDFYFKITNSEHKVELKEKFQRMCDKSMIKSRYMYLTEEILKENPSVCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNIDKALVEAFQPLNISDYNSIFWIAHPGGPAILDQVEQKLALKPEKMKATRDVLSEYGNMSSACVLFILDEMRKKSAQNGLKTTGEGLDWGVLFGFGPGLTIETVVLHSVAI

SEQ ID NO: 1389 - protein, 389 aa, Trifolium subterraneum
MVSVAEIRKAQRAEGPATILAIGTANPANKVEQATYPDFYFKITNSEHKTELKEKFQRMCDKSMIKSRYMYLTEEILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNIDKALVEAFQPLNISDYNSIFWIAHPGGPAILDQVEQKLALKPEKMKATRDVLSEYGNMSSACVLFILDEMRKKSAQNGLKTTGEGLDWGVLFGFGPGLTIETVVLHSVAI

SEQ ID NO: 1390 - protein, 388 aa, Vigna unguiculata
MVSVSEIRQAQRAEGPATILAIGTATPPNCVDQSTYPDYYFRITNSEHMTDLKEKFQRMCDKSMIKKRYMHVTEEILKENPSMCAYMAPSLDARQDIVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEITAVTFRGPSDTHLDSLVGQALFGDGAAAVIVGSDPIPQIEKPLFELVWTAQTIAPDSEGAIDGHLREVGLTFHLLKDVPGIVSKNIGKALSEAFDPLNISDYNSIFWIAHPGGPAILDQVAQKLGLKPEKMKATRDVLSDYGNMSSACVTFHLDEIEKSVENGLKTTGKDLEWGVLFGFGPGLSLETVVLHSVAI

SEQ ID NO: 1391 - protein, 393 aa, Vitis vinifera
MVSVAEIRKAQRAEGPATVLAIGTATPANCVYQADYPDYYFRITNSEHMTELKEKFKRMCEKSMINKRYMHLTEEILKENPNVCAYMAPSLDARQDMVVVEVPKLGKEAAAKAIKEWGQPKSKITHLVFCTTSGVDMPGADYQLTKLLGLKPSVKRLMMYQQGCFAGGTVLRLAKDLAENNAGSRVLVVCSEITAVTFRGPSDTHLDSLVGQALFGDGAAAVIIGADPDTKIELPLFELVSAAQTILPDSEGAIDGHLREVGLTFHLLKDVPGLISKNIEKSLVEAFTPIGISDWNSLFWIAHPGGPAILDQVELKLGLKEEKLRATRHVLSEYGNMSSACVLFILDEMRKKSIEEGKGSTGEGLEWGVLFGFGPGLTVETVVLHSVSAPAAH

SEQ ID NO: 1392 - protein, 151 aa, Malus domestica
DLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAKCVPNSIVMHIGDTLEILSNGKYKSILHRGMVNKEKVRISWAVF

SEQ ID NO: 1393 - protein, 72 aa, Malus domestica
LALGVEAHTDVSALTFILHNMVPGLQLFYEGKWVTAKCVPNSIVMHIGDTLEILSNGKYKSILHRGMVNKEK

SEQ ID NO: 1394 - protein, 147 aa, Ateles belzebuth
MVHLTAEEKAAITSLWGKMNVEEAGGEALGRLLVVYPWTQRFFDNFGNLSSPSAILGNPKVKAHGKKVLTSFGDAIKNMDNLKTTFAKLSELHCDKLHVDPENFRLLGNVMVIILATHFGKEFTPEVQAAWQKLVSAVAIALGHKYH

SEQ ID NO: 1395 - protein, 147 aa, Lagothrix lagotricha
MVHFTAEEKAAITSLWGKMNVEEAGGEALGRLLVVYPWTQRFFDNFGNLSSPSAILGNPKVKAHGKKVLTSFEDAIKNMDNLKTTFAKLSELHCDKLHVDPENFRLLGNVMVIILATHFGKEFTPEVQAAWQKLVSAVAIALGHKYH

SEQ ID NO: 1396 - protein, 147 aa, Leontopithecus rosalia
MVHFTAEEKAAITSLWGKMNVEEAGGESLGRLLVVYPWTQRFFDNFGNLSSPSAILGNPKVKAHGKKVLTSFGDAIKNMDNLKTTFAKLSELHCDKLHVDPENFRLLGNVMVIILATHFGKEFTPEVQAAWQKLVSAVAIALGHKYH

SEQ ID NO: 1397 - protein, 147 aa, Pithecia irrorata
MVHFTAEEKAAITSLWGKMNVEEAGGEALGRLLVVYPWTQRFFDNFGNLSSPSAILGNLKVKAHGKKVLTSFGDAIKNMDNLKTTFAKLSELHCDKLHVDPENFRLLGNVMVIILATHFGKEFTPEVQAAWQKLVSAVAIALGHKYH

SEQ ID NO: 1398 - protein, 147 aa, Saguinus midas
MVHFTAEEKAAITSLWGKMNVEEAGGEALGRLLVVYPWTQRFFDNFGNLSFPSAILGNPKVKAHGKKVLTSFGDAIKNMDNLKTTFAKLSELHCDKLHVDPENFRLLGNVLVIILATHFGKEFTPEVQAAWQKLVSAVAIALGHKYH

SEQ ID NO: 1399 - protein, 387 aa, Xenopus laevis
MAESSKVFKKSSGDGKLAIYLAKRDYVDHVDHVEPVDGMIIIDPEYQKDKKVFVTLACTFRYGRDDHELIGLSFKKELCFLHCQVYPPLPEDKKPLTPLQEKLSKKLGVNAFPFCFNMTTDLPCSVTLQPGPEDTGKKCGVDFEVKGFWADNVEEKISRKNSVQLIIRKVQFAPEATGTASCVQTTRQFMMSDKPLQVEVSLDKEVYYHGEPVGIKLKINNNTSKIVKKIKITVEQLTDVVLYSLDKYTKIVCCEEINETVAANANFSGSYSLTPLLANNKEKRGLALDGKLKHGDTNLASSTILRPGMDKEVLGMLVSYKVRVSLVVARGGILGDLTSSDVSVELPFTLMHPKPSPDQTNIEDVVIEEFARQKLQGAEGEDDKDDA

SEQ ID NO: 1400 - protein, 378 aa, Haliotis madaka
MADIQLSKYHVSKDIGFLLEPLQDVLPDYFEPWNRLAKSLPELVASHKFRDAVKEMPLLDQSKLAGYRQKRLAHLQLVLITSGYLWQEGEGGAVQRLPECVSKPLWNVSNDLGLKPVLTFADICLTNCKVKNGDIEVMYNLPGGAGTEWFLKVCGLVELAFGKSGQAIQNVLDGAKANDKAKMASGFTDLTAAIGNMQTALARMNENLTPEHFYNGVRPFLNGFGGPASPISGGLVYEGVSDKPVTMIGGSAAQSSTMQVLDGLLGITHSPEKQAFLDEIRNYMPPSHKQMLADLTNMPRKVPQVVAETKDANLTKAFNGCVAAFVQYRSYHIQVVTKYIVTASKSDSPKSLAYKDTGKSDLIPFLKEVRDDTEKVQQ

SEQ ID NO: 1401 - protein, 381 aa, Mus musculus
MSPFASESAWLCLAAAAVLGGTLLCGCRSGRQLRSQAVCLAGLWGGACLLSLSLLCTLFLLSVACFLLLYMSSSDQDLLPVDQKAVLVTGADSGFGHGLAKHLDKLGFTVFAGVLDKEGPGAEELRKHCSERLSVLQMDVTKPEQIKDAHSKVTEKIQDKGLWAVVNNAGVFHLPIDGELIPMSIYRKCMAVNFFGTVEVTKAFLPLLRKSKGRLVNVSSMGGTVPLQMTSAYAATKAALTMFSTIIRQELDKWGVKVVTIKPGGFKTNITGSQDIWDKMEKEILDHFSKDIQENYGQDYVHTQKLIIPTLKERSNPDITPVLRDIQHAISARNPSSFYYPGRMAYLWVCLAAYCPTSLLDYVIKKGFYPQPTPRALRTVH

SEQ ID NO: 1402 - protein, 71 aa, Mus musculus
SGIIKTLLRCPNKKKHKAIRLIFVVMIVFFIFWTPYNLVLLFSAFHSTFLETSCQQSKHLDLAMQVTEVIA

SEQ ID NO: 1403 - protein, 35 aa, Mus musculus
TLLRCPNKKKHKAIRLIFVVMIVFFIFWTPYNLVL

SEQ ID NO: 1404 - protein, 88 aa, Rattus norvegicus
PEIKTILSGFIIRGYLGKWTLVIKTITLVLAVSSGLSLGKEGPLVHVACCCGNILCHCFNKYRKNEAKRREVLSAAAAAGVSVAFGAP

SEQ ID NO: 1405 - protein, 48 aa, Rattus norvegicus
YLGKWTLVIKTITLVLAVSSGLSLGKEGPLVHVACCCGNILCHCFNKY

SEQ ID NO: 1406 - protein, 433 aa, Xenopus laevis
MSDKLSYKVADISLADWGRKAIEIAENEMPGLMKMREMHSESKPLKGARIAGCLHMTLQTAVLIETLTALGAEVQWSSCNIFSTQDHAAAAIAKTGVPVYAWKGETDEEYIWCIEQTIYFKDGKPLNMILDDGGDLTNLVHSKYPQLLKGIKGISEETTTGVHNLYKMKSSGTLQVPAINVNDSVTKSKFDNLYGCRESLIDGIKRATDVMIAGKVAVVAGYGDVGKGCAQALRAFGARVIITEIDPINALQAAMEGYEVTTMDEASKEGNIFVTTTGCADIVEGRHFENMKDDSIVCNIGHFDIELDVKWLNENAVKKVNIKPQVDRYLLKNGRHIILLAEGRLVNLGCAMGHPSFVMSNSFTNQVMAQIELWTNTDKYPVGVYFLPKKLDEAVAAAHLDKLGVKLTKLTDKQAKYLGLDKEGPFKPDHYRY

SEQ ID NO: 1407 - protein, 523 aa, Mus musculus
MGKPTSSGCDWRRFLRNHWLLLSTVAAVVLGIVLGVVVRGHSELSNLDKFYFAFPGEILMRMLKLVILPLIVSSMITGVAALDSNVSGKIGLRAVVYYFSTTVIAVILGIVLVVSIKPGVTQKVNDINRTGKTPEVSTMDAMLDLIRNMFPENLVQACFQQYKTKREEVKPVGDPGGNATEVSVTTAMTTMSENKTKEYKIVGLYSDGINVLGLIIFCLVFGLVIGKMGEKGQILVDFFNALSDATMKIVQIIMCYMPIGILFLIAGKIIEVEDWEIFRKLGLYMATVLSGLAIHSLIVLPLLYFIVVRKNPFRFALGMAQALLTALMISSSSATLPVTFRCAEEKNQVDKRITRFVLPVGATINMDGTALYEAVAAVFIAQLNGLDLSIGQIVTISITATAASIGAAGVPQAGLVTMVIVLSAVGLPAEDVTLIIAVDWLLDRFRTMVNVLGDAFGTGIVEKLSKKELEQMDVSSEVNIVNPFALEPTTLDNEDSDTKKSYVNGGFAVDKSDTISFTQTSQF

SEQ ID NO: 1408 - protein, 523 aa, Rattus norvegicus
MGKPTSSGCDWRRFLRNHWLLLSTVAAVVLGIVVGVLVRGHSELSNLDKFYFAFPGEILMRMLKLVILPLIISSMITGVAALDSNVSGKIGLRAVVYYFSTTVIAVILGIVLVVSIKPGVTQKVNEINRTGKTPEVSTVDAMLDLIRNMFPENLVQACFQQYKTKREEVKPASDPGGNQTEVSVTTAMTTMSENKTKEYKIVGLYSDGINVLGLIIFCLVFGLVIGKMGEKGQILVDFFNALSDATMKIVQIIMCYMPIGILFLIAGKIIEVEDWEIFRKLGLYMATVLSGLAIHSLVVLPLIYFIVVRKNPFRFALGMAQALLTALMISSSSATLPVTFRCAEEKNHVDKRITRFVLPVGATINMDGTALYEAVAAVFIAQLNGMDLSIGQIITISITATAASIGAAGVPQAGLVTMVIVLSAVGLPAEDVTLIIAVDWLLDRFRTMVNVLGDAFGTGIVEKLSKKELEQVDVSSEVNIVNPFALEPTILDNEDSDTKKSYVNGGFSVDKSDTISFTQTSQF

SEQ ID NO: 1409 - protein, 282 aa, Micropogonias undulatus
MGEWDLLGRLLDKVQSHSTVIGKVWLTVLFVFRILVLRTGADRVWGDEQSDFVCNTQQPGCENVCYDLAFPISHVRFWFLQIIAVATPKLLYLGHVLHVIHAEKKMKERMKKQAELDDQTNLFLRKAYKVPKYTKSSGKISIRGRLLRSYVYHLVAKIILEVLFIVGQYFLYGFTLDTRYVCTRFPCPHKVDCFLSRPTEKSVIIWFMLVAAFVSLFLSLVELFYLCVKAAKECMARRQDYTVTPVTPPLLARKSFKSHKEVFQNCVNEPASPENNMEEVHI

SEQ ID NO: 1410 - protein, 142 aa, Micropogonias undulatus
MGEWDLLGRLLDKVQSHSTVIGKVWLTVLFVFRILVLRTGADRVWGDEQSDFVCNTQQPGCENVCYDLAFPISHVRFWFLQIIAVATPKLLYLGHVLHVIHAEKKMKERMKKQAELDDQTNLFLRKAYKVPKYTKSSGKISI

SEQ ID NO: 1411 - protein, 126 aa, Micropogonias undulatus
VATPKLLYLGHVLHVIHAEKKMKERMKKQAELDDQTNLFLRKAYKVPKYTKSSGKISIRGRLLRSYVYHLVAKIILEVLFIVGQYFLYGFTLDTRYVCTRFPCPHKVDCFLSRPTEKSVIIWFMLV

SEQ ID NO: 1412 - protein, 33 aa, Mus musculus
YVELTEGVECIQKHSKISGRDLTFWQELVSKCL

SEQ ID NO: 1413 - protein, 147 aa, Mus musculus
VQAKHLGCVGLSCFYLAVKATEEERNVPLATDLIRISQYRFTVSDLMRMEKIVLEKVCWKVKATTAFQFLQLYYSLVHDTLPFERRNDLNFERLEAQLKACHCRIIFSKAKPSVLALSILALEIQALKYVELTEGVECIQKHSKISG

SEQ ID NO: 1414 - protein, 302 aa, Carassius auratus
MDDYLKIEKIGEGTYGVVYKGRNKTTGQVVAMKKIRLESEEEGVPSTAVREISLLKELQHPNVVRLLDVLMQESKLYLVFEFLSMDLKKYLDSIPSGQFMDPMLVKSYLYQILEGILFCHCRRVLHRDLKPQNLLIDNKGVIKLADFGLARAFGVPVRVYTHEVVTLWYRAPEVLLGASRYSTPVDVWSIGTIFAELATKKPLFHGDSEIDQLFRIFRTLGTPNNEVWPDVESLPDYKNTFPKWKSGNLASTVKNLDKNGIDLLTKMLIYDPPKRISARQAMTHPYFDDLDKSTLPASNLKI

SEQ ID NO: 1415 - protein, 949 aa, Rattus norvegicus
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANRVAALSEIAESHPSSNLLDLKAQSINKLLTALNECTEWAQIFILDCLGNYMPKDDREAQSICERVTPRLSHANSAVVLSAVKVLMKFMEMLSKDLDYYATLLKKLAPPLVTLLSAEPEPQYVPLRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLDGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPNAFVEGGRGVVHKSLPPRTASSESTESPEAAPAGAPASDQPDVIPAQGDLLGDLLNLDLGPPVSGPPLAASSVQMGAVDLLGGGLDSLMGDEPEGIGDSNFGAPPASVAAAAPARLGAPVSSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLNTVGSVMKMEPLNNLQVAVKNNIDVFYFSTLYPLHVLFVEDGKMDRQMFLATWKDIPNENEAQFQIRDCPLNTEAASSKLQSSNIFTVAKRTVEGQDMLYQSLKLTNGIWVLAELRIQPGNPSFTLSLKCRAPEVSQHDIQAYETILKN

SEQ ID NO: 1416 - protein, 942 aa, Rattus norvegicus
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANRVAALSEIAESHPSSNLLDLKAQSINKLLTALNECTEWAQIFILDCLGNYMPKDDREAQSICERVTPRLSHANSAVVLSAVKVLMKFMEMLSKDLDYYATLLKKLAPPLVTLLSAEPEPQYVPLRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLDGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPNAFVEGGRGVVHKSLPPRTASSESTESPEAAPAGAPASDQPDVIPAQGDLLGDLLNLDLGPPVSGPPLAASSVQMGAVDLLGGGLDSLIGDSNFGAPPASVAAAAPARLGAPVSSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLNTVGSVMKMEPLNNLQVAVKNNIDVFYFSTLYPLHVLFVEDGKMDRQMFLATWKDIPNENEAQFQIRDCPLNTEAASSKLQSSNIFTVAKRTVEGQDMLYQSLKLTNGIWVLAELRIQPGNPSFTLSLKCRAPEVSQHDIQAYETILKN

SEQ ID NO: 1417 - protein, 294 aa, Vigna unguiculata
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSSMLSLDPSKRITARIAVEHEYFKDIKFVP

SEQ ID NO: 1418 - protein, 435 aa, Spinacia oleracea
MAVAELSPCYQTQIVKPPHLSWLSNNHKLNLLGLPKASRITEICCSLAPNQVQTPVAVPTGAQSIKPECYGVFCWTYDLKKEEETRSWKKMITIAISGAAGTISNHLLFKLASGVVFGPDQPIALKLLGSEKSFHALEGVAMELEDSLYPLLREVSIGIDPYEVFEDAEWALLIGAKPRGPGMERADLLDINGKIYAEQGKALNAVASPNVKVIVVGNPCNTNALICLKNPPNIPAKNFHSLTRLDENRAKCQLALKAGVFYDKVSNVTIWGNHSTTQVPDFVNAQIGGVPVKEVIKAQKWLEEEFTEKVRKRGGVLIQKWGRSSAASTAVSIVDAINPLITPTPPGDWFPSGVYTNGNPYGIAEDLIYSMPCRSKGDGDYELVKDVIFDDYLRKRIKTSEEELLAEKRCTAHLTGEGIAVCDLPAGDTMLPGEM

SEQ ID NO: 1419 - protein, 428 aa, Saccharomyces cerevisiae
MSDVLSQYKGCSVRDLPTPNFVINEEKFDKNCTTMLNNVEKLSQECGVPIKFRAHVKTHKTAKGTLKQLGHGLPLAKRTTRAILVSTLKEAEELLNYQDRQCSDYIDDITYSLPCCVPEFIPLLSNLSRRVNNFQVFVDNIEHLENLKNFGRPASGKKWSVFIKVDMGTKRAGLAFDSPEFLSLLKKLTSSEIKEVIEPYGFYAHAGHSYSSTSINDTQNLLMEEVKAVNSAAKVLCSVDPQFDPSKLTLSVGATPTSNSLKLDNKSTLVKFITTQLVSTLEIHCGNYCMYDLQQVATGCVQDHELSGFVLGTVLSSYPSRGELLSNTGVMCLTREASSIKGFGICADLEHVLKSESFSREWYVARVSQEHGILRPIRNWNETTPLKLGSKIAVLPQHACITMGQFPYYFVVNSEGIVNDVWLPFQKW

SEQ ID NO: 1420 - protein, 465 aa, Saccharomyces cerevisiae
MPIKRLDTVVVNTGSQNDQHSASVPPVYLSTTFKVDLNNEDAQNYDYSRSGNPTRSVLQHQIGKLYRVPQENVLAVSSGMTALDVILRGLVLLNGTDNHTPTIIAGDDLYGGTQRLLNFFKQQSHAVSVHVDTSDFEKFKTVFQSLDKVDCVLLESPTNPLCKVVDIPRILRFVKCISPDTTVVVDNTMMSGLNCNPLQLNPGCDVVYESATKYLNGHHDLMGGVIISKTPEIASKLYFVINSTGAGLSPMDSWLLVRGLKTLGVRLYQQQRNAMILAHWLENSCGFKPTRTNKATKTRFVGLRSNPDFKLHKSFNNGPGAVLSFETGSFEHSKRLVSSKKLSIWAVTVSFGCVNSLLSMPCKMSHASIDPELRKERDFPEDLVRLCCGIENIVDLKKDLLAAMVDADIIEVRENGKYLFNKLNKNLAVNTTIDDLHKPLSIYEEFYNQDLIRKDSELNIKSSKL

SEQ ID NO: 1421 - protein, 81 aa, Saccharomyces cerevisiae
LDLTFEIDEPESSAKVVDLIPNGSKTYVTKDNVLLYVTKVTDYKLNKRCFKPVSAFHGGLSVIIAPHWMEMFNSIELQMLI

SEQ ID NO: 1422 - protein, 77 aa, Saccharomyces cerevisiae
VDLIPNGSKTYVTKDNVLLYVTKVTDYKLNKRCFKPVSAFHGGLSVIIAPHWMEMFNSIELQMLISGERDNIDLDDL

SEQ ID NO: 1423 - protein, 128 aa, Saccharomyces cerevisiae
VANLGQITDYLVVKGVPNLLQKMFKESVLADNVVFRLFPTSHPYIPVLHGKSKYMASLNAMRMIVRKFILGDECRLHISSVKTLTSTSHDEEVKSALQSYNTITCNDKLVIKWQSCIPEDHCKITKLE

SEQ ID NO: 1424 - protein, 110 aa, Saccharomyces cerevisiae
LGQITDYLVVKGVPNLLQKMFKESVLADNVVFRLFPTSHPYIPVLHGKSKYMASLNAMRMIVRKFILGDECRLHISSVKTLTSTSHDEEVKSALQSYNTITCNDKLVIKW

SEQ ID NO: 1425 - protein, 142 aa, Stylosanthes hamata
AGVTQMLLGVCRLGFLIDFLSHAAIVGFMAGAAITIGLQQLKGLLGISNNNFTKKTDIISVMRSVWTHVHHGWNWETILIGLSFLIFLLITKYIAKKNKKLFWVSAISPMISVIVSTFFVYITRADKRGVSIVKHIKSGVNP

SEQ ID NO: 1426 - protein, 129 aa, Stylosanthes hamata
MLLGVCRLGFLIDFLSHAAIVGFMAGAAITIGLQQLKGLLGISNNNFTKKTDIISVMRSVWTHVHHGWNWETILIGLSFLIFLLITKYIAKKNKKLFWVSAISPMISVIVSTFFVYITRADKRGVSIVK

SEQ ID NO: 1427 - protein, 644 aa, Stylosanthes hamata
MSSLGTEQFSERSQWVLNSPNPPPLTKKFLGPLKDNKFFTSSSSKKETRAVSFLASLFPILSWIRTYSATKFKDDLLSGLTLASLSIPQSIGYANLAKLDPQYGLYTSVIPPVIYALMGSSREIAIGPVAVVSMLLSSLVPKVIDPDAHPNDYRNLVFTVTLFAGIFQTAFGVLRLGFLVDFLSHAALVGFMAGAAIVIGLQQLKGLLGLTHFTTKTDAVAVLKSVYTSLHQQITSSENWSPLNFVIGCSFLIFLLAARFIGRRNKKFFWLPAIAPLLSVILSTLIVFLSKGDKHGVNIIKHVQGGLNPSSVHKLQLNGPHVGQAAKIGLISAIIALTEAIAVGRSFANIKGYHLDGNKEMLAMGCMNIAGSLTSCYVSTGSFSRTAVNFSAGCKTAVSNIVMAVTVLLCLELFTRLLYYTPMAILASIILSALPGLIDIGEAYHIWKVDKFDFLACLGAFFGVLFVSIEIGLLIALSISFAKILLQAIRPGVEVLGRIPTTEAYCDVAQYPMAVTTPGILVIRISSGSLCFANAGFVRERILKWVEDEEQDNIEEAAKGRVQAIIIDMTDLTNVDTSGILALEELHKKLLSRGVELAMVNPRWEVIHKLKVANFVDKIGKERVFLTVAEAVDACLSSRFANSA

SEQ ID NO: 1428 - protein, 363 aa, Lampetra japonica
MSPHFPALTPDQKKELADIAQRIVASGKGILAADESVGTMGKRLTQIGLENTDEHRRFYRQLLFTTDPSIKEHIGGIIFFHETMYQKTDGGVPFVKLVKDNGILVGIKVDKGVVPLAGTNGEGTTQGLDGLAERCAQYKKDGADFAKWRCVLKISPNTPSRLSIVENANVLARYATICQQNGLVPIVEPEILPDGDHDLKTCQYITEKVLAATYKALSDHHVYLEGTLLKPNMVTVGTAAPASTRPEQVAMATLTALRRTVPPAVPGITFLSGGQSEEDASIHLNAINKLHLIKPWALTFSYGRALQASVLKAWGGKKENLKAAQDELMRRAKINGQASKGEYKPTGTGAAAGESLFVANHAY

SEQ ID NO: 1429 - protein, 394 aa, Gallus gallus
MDTLGRKVVVCDNGTGFVKCGYAGSNFPEHIFPALVGRPIIRSTAKVGNIEIKDLMVGDEASELRSMLEVNYPMENGIVRNWDDMKHLWDYTFGPEKLNIDTKNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 1430 - protein, 152 aa, Mycoplasma pneumoniae
MQMNHPIYIASDHTGLELKSLVIKHLEQQKLQVIDLGPTELDPLDDYPDYAFLLAQTMQANPNSLGILICGTGVGVCMAANKAKGILAALVVDSKTAALARQHDDANVLCLSSRFVVPEENIKIVDEFLQAQFEGGRHSKRVGKIIAYEREK

SEQ ID NO: 1431 - protein, 437 aa, Neocallimastix frontalis
MLANVTRSTSKAAPALASIAQTAQKRFLSVHEYCSMNLLHEYNVNAPKGIVAKTPEEAYQAAKKLNTEDLVIKAQVLAGGRGKGHFDSGLQGGVKLCYTPEQVKDYASKMLGHKLITKQTGAAGRDCNAVYVVERQYAAREYYFAILLDRATRGPVLVASSEGGVEIEEVAKTNPDAILTVPFSIKTGLTREVALDTAKKMGFTEKCVPQAADTFMKLYKIFIEKDATMVEINPMAENNRGEVVCMDAKFGFDDNASYKPKGIFALRDTTQEDPREVAGHAKWNLNYVGMEGNIGCLVNGAGLAMATMDIIKLNGGVPANFLDVGGSATAKQVKEAFKIISSDKAVSAILVNIFGGIMRCDIVAEGVIQAVKELGLDIPLVVRLQGTKVEEARELIKNSNLSLYAIDDLDKAAKKVVQLANVVGLAKENGIKIKIEN

SEQ ID NO: 1432 - protein, 433 aa, Sus scrofa
IPAAPVAAQARKLLRDLAFRPPLLAARSQVVQLTPRRWLNLQEYQSKKLMSDNGVKVQRFFVADTANEALEAAKRLNAKEIVLKAQILAGGRGKGVFSSGLKGGVHLTKDPEVVGQLAKQMIGYNLATKQTPKEGVKVNKVMVAEALDISRETYLAILMDRSCNGPVLVGSPQGGVDIEEVAASNPELIFKEQIDIIEGIKDSQAQRMAENLGFLGPLQNQAADQIKKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKESQVYQAFKLLTADPKVEAILVNIFGGIVNCAIIANGITKACRELELKVPLVVRLEGTNVHEAQNILTNSGLPITSAVDLEDAAKKAVASVTKK

SEQ ID NO: 1433 - protein, 137 aa, Gallus gallus
GQAIKVTHKATGKVMVMKELIRCDEETQKTFLTEVKVMRSLDHPNVLKFIGVLYKDKKLNLLTEYIEGGTLKDFLRNADPFPWQQKVSFAKGIASGMAYLHSMCIIHRDLNSHNCLIKLDKTVVVADFGLSRLIVEE

SEQ ID NO: 1434 - protein, 130 aa, Gallus gallus
VTHKATGKVMVMKELIRCDEETQKTFLTEVKVMRSLDHPNVLKFIGVLYKDKKLNLLTEYIEGGTLKDFLRNADPFPWQQKVSFAKGIASGMAYLHSMCIIHRDLNSHNCLIKLDKTVVVADFGLSRLIV

SEQ ID NO: 1435 - protein, 137 aa, Rattus norvegicus
GQAIKVTHKATGKVMVMKELIRCDEETQKTFLTEVKVMRSLDHPNVLKFIGVLYKDKKLNLLTEYIEGGTLKDFLRNVDPFPWQQKVRFAKGIASGMAYLHSMCIIHRDLNSHNCLIKLDKTVVVADFGLSRLIVEE

SEQ ID NO: 1436 - protein, 125 aa, Rattus norvegicus
TGKVMVMKELIRCDEETQKTFLTEVKVMRSLDHPNVLKFIGVLYKDKKLNLLTEYIEGGTLKDFLRNVDPFPWQQKVRFAKGIASGMAYLHSMCIIHRDLNSHNCLIKLDKTVVVADFGLSRLIV

SEQ ID NO: 1437 - protein, 137 aa, Rattus norvegicus; identical to SEQ ID NO: 1435

SEQ ID NO: 1438 - protein, 125 aa, Rattus norvegicus; identical to SEQ ID NO: 1436

SEQ ID NO: 1439 - protein, 223 aa, Candida albicans
MFRSLVRKTTPLLAFGVGIAAFPKDWRKGQFGDKKLLVINDSVLEQIRSTDRYKQLVNDPNLKHYNSSHAFPDQHHKNYVNTGLLFGPDLMEIDPIVFLDEKNGELTSFYHLGDKLISQDGQIHNGIVSTILDEGLCSAGFPLLPSKKGVTASLSIDFKNQAPPQSTVVLHAKVKEAKGRKVVIEGYLETLPLNKSETPLLIAESKCVLVEPKWFKYFAWLQV

SEQ ID NO: 1440 - protein, 317 aa, Saccharomyces cerevisiae
MTSTLHTTKKVLSIQSHVIHGYVGNKAATFPLQYRGWDVDVLNTVQFSNHSGYAHFTGFKCSTEELVDIVEKGLIGSLRIKYDAVLSGYLPNVQALQKVAGIVGQLCEGSENVKWILDPVLGDNGRLYVDRECVAVYQDILQNFKIFLATPNQFEMELLVGMSIRTLDDAKQAFKLFHKKYPRVSRIVVTSLELSEFLSNDTYVVAGFDCSASEEIFFYEIPKINAKFSGSGDLISAMLTDSLLGDRRCTQLSLSASLGQVLWLVTSILQKTYDLNIAERGPQDSTIDIKDLKLIQCRDILKQDLIPSIGKPKTIKI

SEQ ID NO: 1441 - protein, 34 aa, Saccharomyces cerevisiae
RFIIYAVPSIMLLGATGAAHLWENMKVKKITNVL

SEQ ID NO: 1442 - protein, 33 aa, Saccharomyces cerevisiae
FIIYAVPSIMLLGATGAAHLWENMKVKKITNVL

SEQ ID NO: 1443 - protein, 83 aa, Rattus norvegicus
DVPNGFHVSLEKIPTEGEDLKLSCVVSKFLYRDITWILLRTVNNRTMHHSISKQKMATTQDYSITLNLVIKNVSLEDSGTYAC

SEQ ID NO: 1444 - protein, 54 aa, Rattus norvegicus
LKLSCVVSKFLYRDITWILLRTVNNRTMHHSISKQKMATTQDYSITLNLVIKNV

SEQ ID NO: 1445 - protein, 464 aa, Arabidopsis thaliana
MTSSLSLHSSFVPSFADLSDRGLISKNSPTSVSISKVPTWEKKQISNRNSFKLNCVMEKSVDGQTHSTVNNTTDSLNTMNIKEEASVSTLLVNLDNKFDPFDAMSTPLYQTATFKQPSAIENGPYDYTRSGNPTRDALESLLAKLDKADRAFCFTSGMAALSAVTHLIKNGEEIVAGDDVYGGSDRLLSQVVPRSGVVVKRVNTTKLDEVAAAIGPQTKLVWLESPTNPRQQISDIRKISEMAHAQGALVLVDNSIMSPVLSRPLELGADIVMHSATKFIAGHSDVMAGVLAVKGEKLAKEVYFLQNSEGSGLAPFDCWLCLRGIKTMALRIEKQQENARKIAMYLSSHPRVKKVYYAGLPDHPGHHLHFSQAKGAGSVFSFITGSVALSKHLVETTKYFSIAVSFGSVKSLISMPCFMSHASIPAEVREARGLTEDLVRISAGIEDVDDLISDLDIAFKTFPL

SEQ ID NO: 1446 - protein, 449 aa, Arabidopsis thaliana
MTSSLSLHSSFVPSFADLSDRGLISKNSPTSVSISKVPTWEKKQISNRNSFKLNCVMEKSVDAMNIKEEASVSTLLVNLDNKFDPFDAMSTPLYQTATFKQPSAIENGPYDYTRSGNPTRDALESLLAKLDKADRAFCFTSGMAALSAVTHLIKNGEEIVAGDDVYGGSDRLLSQVVPRSGVVVKRVNTTKLDEVAAAIGPQTKLVWLESPTNPRQQISDIRKISEMAHAQGALVLVDNSIMSPVLSRPLELGADIVMHSATKFIAGHSDVMAGVLAVKGEKLAKEVYFLQNSEGSGLAPFDCWLCLRGIKTMALRIEKQQENARKIAMYLSSHPRVKKVYYAGLPDHPGHHLHFSQAKGAGSVFSFITGSVALSKHLVETTKYFSIAVSFGSVKSLISMPCFMSHASIPAEVREARGLTEDLVRISAGIEDVDDLISDLDIAFKTFPL

SEQ ID NO: 1447 - protein, 411 aa, Nicotiana benthamiana
MGSLRAILKNPEDLYPLVKLKLAARHAEKQIPPSPNWGFCYSMLHKVSRSFALVIQQLPVELRDAVCIFYLVLRALDTVEDDTSIPTDVKVPILISFHQHVYDREWHFSCGTKEYKVLMDQFHHVSTAFLELRKHYQQAIEDITMRMGAGMAKFICKEVETTDDYDEYCHYVAGLVGLGLSKLFHASEKEDLASDSLSNSMGLFLQKTNIIRDYLEDINEVPKCRMFWPREIWSKYVNKLEELKYEDNSAKAVQCLNDMVTNALPHVEDCLTYMSALRDPSIFRFCAIPQVMAIGTLAMCYDNIEVFRGVVKMRRGLTAKVIDRTRTIADVYGAFFDFSCMLKSKVNNNDPNATKTLKRLEVILKTCRDSGTLNKRKSYIIRSEPNYSPVLIVVIFIILAIILAQLSGNRS

SEQ ID NO: 1448 - protein, 138 aa, Saccharomyces cerevisiae
LKHQAVSFCKVLDSAIDNLENVHVLDDYIVKLGKRHSRILGIKTVGFEVMGKAFMTTLQDRFGSFLTLELKNLWGQLYSYLANCMITAGKDPMEKIQPDFSYNGDSVVLNFSIPKLAMHDISTVNKLQMVKTKNATIP

SEQ ID NO: 1449 - protein, 66 aa, Saccharomyces cerevisiae
CKVLDSAIDNLENVHVLDDYIVKLGKRHSRILGIKTVGFEVMGKAFMTTLQDRFGSFLTLELKNLW

SEQ ID NO: 1450 - protein, 111 aa, Saccharomyces cerevisiae
KIFGSGGTTLIAYKDTGKLGLLGKFHNIIVFYSSPVIKHIMKSRDGNEPNLNWIRLMFAKAFELFVKVSTILIYLAYGVSGTVYMVTAGFFFVLCLLFTVIRRYKGVHRML

SEQ ID NO: 1451 - protein, 75 aa, Saccharomyces cerevisiae
KDTGKLGLLGKFHNIIVFYSSPVIKHIMKSRDGNEPNLNWIRLMFAKAFELFVKVSTILIYLAYGVSGTVYMVTA

SEQ ID NO: 1452 - protein, 376 aa, Saccharomyces cerevisiae
MSASIPETMKAVVIENGKAVVKQDIPIPELEEGFVLIKTVAVAGNPTDWKHIDFKIGPQGALLGCDAAGQIVKLGPNVDAARFAIGDYIYGVIHGASVRFPSNGAFAEYSAISSETAYKPAREFRLCGKDKLPEGPVKSLEGAVSLPVSLTTAGMILTHSFGLDMTWKPSKAQRDQPILFWGGATAVGQMLIQLAKKLNGFSKIIVVASRKHEKLLKEYGADELFDYHDADVIEQIKKKYNNIPYLVDCVSNTETIQQVYKCAADDLDATVVQLTVLTEKDIKEEDRRQNVSIEGTLLYLIGGNDVPFGTFTLPADPEYKEAAIKFIKFINPKINDGEIHHIPVKVYKNGLDDIPQLLDDIKHGRNSGEKLVAVLK

SEQ ID NO: 1453 - protein, 246 aa, Saccharomyces cerevisiae
MESIFGGFGDLVVPRPKEHLGQTDLSFGGKLLPALKICEDGGESGCGGKVWIAGELLCEYILEKSVDHLLSKTVNGTKQFKKVLELGSGTGLVGLCVGLLEKNTFHDGTKVYVTDIDKLIPLLKRNIELDEVQYEVLARELWWGEPLSADFSPQEGAMQANNVDLVLAADCVYLEEAFPLLEKTLLDLTHCINPPVILMAYKKRRKADKHFFNKIKRNFDVLEITDFSKFEHYLKERTHLFQLIRK

SEQ ID NO: 1454 - protein, 1044 aa, Saccharomyces cerevisiae
MSDSQQSITVLEELFRKLETATSETREGISSELSSFLNGNIIEHDVPEVFFDEFQKAIQSKQKALNTLGAVAYIANETNLSPSVEPYIVATVPSVCSKAGSKDNDVQLAATKALKAIASAVNPVAVKALLPHLIHSLETSNKWKEKVAVLEVISVLVDAAKEQIALRMPELIPVLSESMWDTKKGVKEAATTTITKATETVDNKDIERFIPKLIECIANPNEVPETVHLLGATTFVAEVTPATLSIMVPLLSRGLAERETSIKRKAAVIIDNMCKLVEDPQVVAPFLGKLLPGLKNNFATIADPEAREVTLKALKTLRRVGNVGEDDVLPEISHAGDVSTTLGVIKELLEPEKVAPRFTIVVEYIAAIAANLIDERIIDQQTWFTHVTPYMTIFLHEKTAKEILDDFRKRAVDNIPVGPNFQDEEDEGEDLCNCEFSLAYGAKILLNKTQLRLKRGRRYGLCGPNGAGKSTLMRSIANGQVDGFPTQDECRTVYVEHDIDNTHSDMSVLDFVYSGNVGTKDVITSKLKEFGFSDEMIEMPIASLSGGWKMKLALARAVLKDADILLLDEPTNHLDTVNVEWLVNYLNTCGITSVIVSHDSGFLDKVCQYIIHYEGLKLRKYKGNLSEFVQKCPTAQSYYELGASDLEFQFPTPGYLEGVKTKQKAIVKVSNMTFQYPGTTKPQVSDVTFQCSLSSRIAVIGPNGAGKSTLINVLTGELLPTSGEVYTHENCRIAYIKQHAFAHIESHLDKTPSEYIQWRFQTGEDRETMDRANRQINENDAEAMNKIFKIEGTPRRVAGIHSRRKFKNTYEYECSFLLGENIGMKSERWVPMMSVDNAWLPRGELIESHSKMVAEIDMKEALASGQFRALTRKEIELHCAMLGLDSELVSHSRIRGLSGGQKVKLVLAACTWQRPHLIVLDEPTNYLDRDSLGALSKALKAFEGGVIIITHSAEFTKNLTDEVWAVKDGKMTPSGHNWVAGQGAGPRIEKKEEEGDKFDAMGNKINSGKKKSKLSSAELRKKKKERMKKKKEMGDEYVSSDEDF

SEQ ID NO: 1455 - protein, 109 aa, Saccharomyces cerevisiae
VYSGNVGTKDVITSKLKEFGFSDEMIEMPIASLSGGWKMKLALARAVLKDADILLLDEPTNHLDTVNVEWLVNYLNTCGITSVIVSHDSGFLDKVCQYIIHYEGLKLRK

SEQ ID NO: 1456 - protein, 135 aa, Saccharomyces cerevisiae
EMIEMPIASLSGGWKMKLALARAVLKDADILLLDEPTNHLDTVNVEWLVNYLNTCGITSVIVSHDSGFLDKVCQYIIHYEGLKLRKYKGNLSEFVQKCPTAQSYYELGASDLEFQFPTPGYLEGVKTKQKAIVKV

SEQ ID NO: 1457 - protein, 68 aa, Caenorhabditis elegans
KRVPWASLSKFQIISYVFTFSVTLVTNSITLSKMAKLKKRLLMAERHLCVATAWISSGFVISLIAQAH

SEQ ID NO: 1458 - protein, 80 aa, Caenorhabditis elegans
KRVPWASLSKFQIISYVFTFSVTLVTNSITLSKMAKLKKRLLMAERHLCVATAWISSGFVISLIAQAHFAFFRGDHELVE

SEQ ID NO: 1459 - protein, 148 aa, Drosophila melanogaster
MVARHFSFFLALLILYDLIPSNQGVEINPTIIKQVRKLRMRCLNQTGASVDVIDKSVKNRILPTDPEIKCFLYCMFDMFGLIDSQNIMHLEALLEVLPEEIHKTINGLVSSCGTQKGKDGCDTAYETVKCYIAVNGKFIWEEIIVLLG

SEQ ID NO: 1460 - protein, 193 aa, Glycine max
LIPREKIPCKLISKTSISHDVRLFRFGLPSDGLLMGLAVGKHIFLCVTVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVW

SEQ ID NO: 1461 - protein, 168 aa, Glycine max
LLMGLAVGKHIFLCVTVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVWYVIQESI

SEQ ID NO: 1462 - protein, 77 aa, Bacillus phage SPP1
TVKAAQHLKYVLKGGRGSAKSTHIAMWIILLMMMMPITFLVIRRVYNTVEQSVFEQLKEAIDMLEVGHLWKVSKSPL

SEQ ID NO: 1463 - protein, 94 aa, Bacillus phage SPP1
LSEKFTPHFLEVWRTVKAAQHLKYVLKGGRGSAKSTHIAMWIILLMMMMPITFLVIRRVYNTVEQSVFEQLKEAIDMLEVGHLWKVSKSPLRLT

SEQ ID NO: 1464 - protein, 311 aa, Lactococcus lactis
MTENNRLSVKLPGLDLKNPIIPASGCFGFGEEYAKYYDLNKLGSIMVKATTLHPRFGNPTPRVAETASGMLNAIGLQNPGLEVIMTEKLPWLNENFPELPIIANVAGSEEADYVAVCAKIGDAANVKAIELNISCPNVKHGGQAFGTDPEVAAALVKACKAVSKVPLYVKLSPNVTDIVPIAKAVEAAGADGLTMINTLMGVRFDLKTRQPILANITGGLSGPAIKPVALKLIHQVAQVVDIPIIGMGGVANAQDVLEMYMAGASAVAVGTANFADPFVCPKIIDKLPELMDQYRIESLESLIQEVKEGKK

SEQ ID NO: 1465 - protein, 149 aa, Bacillus subtilis
MENRIDRIKKQLHSSSYKLTPQREATVRVLLENEEDHLSAEDVYLLVKEKSPEIGLATVYRTLELLTELKVVDKINFGDGVSRYDLRKEGAAHFHHHLVCMECGAVDEIEEDLLEDVEEIIERDWKFKIKDHRLTFHGICHRCNGKETE

SEQ ID NO: 1466 - protein, 463 aa, Bacillus subtilis
METLLVVLHVFILFLLILGLFVMQKKHVSFSKRVFTALGLGIVFGFALQLIYGPTSNIVIQTADWFNIAGGGYVKLLQMVVMPLVFISILGAFTKLKLTKNLGKISGLIIGILVATTAVAAAVGIASALSFDLQAIQVDQGSTELSRGQELQQKSEDMTAKTLPQQIVELLPGNPFLDFTGARPTSTIAVVIFAAFLGVAFLGVKHKQPEQAETFKKLVDAVYAIVMRVVTLILRLTPYGVLAIMTKTIATSDLDSILKLGMFVIASYAALITMFIIHLLLLTFSGLNPVIYLKKAVPVLVFAFTSRSSAGALPLNIKTQRSMGVPEGIANFAGSFGLSIGQNGCAGIYPAMLAMMIAPTVGQNPFDPVFIITVIAVVAISSFGVAGVGGGATFAALLVLSSLNMPVALAGLLISIEPLIDMGRTALNVSGSMTSGLITSKVTKEIDQGAFHDQSRVIEAEEA

SEQ ID NO: 1467 - protein, 162 aa, Sus scrofa
KWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKY

SEQ ID NO: 1468 - protein, 168 aa, Sus scrofa
AIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 1469 - protein, 610 aa, Dictyostelium discoideum
MTNFSESEISEFKASFNQFDENGDGQISALELQKILTKCGEKVTGVEVRDMIKEVDTDGNGSIDFKEFLQVMQKARQHSANASPAFASAVKKVGAVNTIGGYSGSTASGVQHSYSDEEKVAYIDWINNCLAKDVDLKSRLPIPEDGDKFFAACNDGLLLCKLINDAVPDTIDERVLNKKNLNAFRINENQVLCINSAKAIGCNVVNIGAGDLVEGRAHLIMGLTWQIIKIGLFARINLTNHPELYRLLHDGETIEDLLKLPVEEILLRWFNYHLAAAGSQRRVKNFSGDIKDSECYTILLKQIAPKDAGVETSALNISNLDQRAVKVLENADKLGCKKFLKPKDIVTGFQKLNLAFVANLFNTHPALEPVEDVVIIEETREEKTFRNWMNSLGVDPFVNNLYEGTYDGLILIQLFDKIYPGLVDHKKVNYPPYKAMGAEMKKIENCNYAIQLGKDCKYSLVGIDGKNVYDKNKTLTLSILWQLMRGHVISILTALSGSGKPIADADIVNWTNSKLSAAGKKQISGFKDSTISTGIPILDVIEAVRPGSVDPALVATSGSAEDNLLNAKLAVSTARKVGAVVFALPEDIVEVKPKMVLTLFASLWQVEMTK

SEQ ID NO: 1470 - protein, 538 aa, Saccharomyces cerevisiae
MSSVAENIIQHATHNSTLHQLAKDQPSVGVTTAFSILDTLKSMSYLKIFATLICILLVWDQVAYQIKKGSIAGPKFKFWPIIGPFLESLDPKFEEYKAKWASGPLSCVSIFHKFVVIASTRDLARKILQSSKFVKPCVVDVAVKILRPCNWVFLDGKAHTDYRKSLNGLFTKQALAQYLPSLEQIMDKYMDKFVRLSKENNYEPQVFFHEMREILCALSLNSFCGNYITEDQVRKIADDYYLVTAALELVNFPIIIPYTKTWYGKKTADMAMKIFENCAQMAKDHIAAGGKPVCVMDAWCKLMHDAKNSNDDDSRIYHREFTNKEISEAVFTFLFASQDASSSLACWLFQIVADRPDVLAKIREEQLAVRNNDMSTELNLDLIEKMKYTNMVIKETLRYRPPVLMVPYVVKKNFPVSPNYTAPKGAMLIPTLYPALHDPEVYENPDEFIPERWVEGSKASEAKKNWLVFGCGPHVCLGQTYVMITFAALLGKFALYTDFHHTVTPLSEKIKVFATIFPKDDLLLTFKKRDPITGEVFE

SEQ ID NO: 1471 - protein, 584 aa, Saccharomyces cerevisiae
MSAKSFEVTDPVNSSLKGFALANPSITLVPEEKILFRKTDSDKIALISGGGSGHEPTHAGFIGKGMLSGAVVGEIFASPSTKQILNAIRLVNENASGVLLIVKNYTGDVLHFGLSAERARALGINCRVAVIGDDVAVGREKGGMVGRRALAGTVLVHKIVGAFAEEYSSKYGLDGTAKVAKIINDNLVTIGSSLDHCKVPGRKFESELNEKQMELGMGIHNEPGVKVLDPIPSTEDLISKYMLPKLLDPNDKDRAFVKFDEDDEVVLLVNNLGGVSNFVISSITSKTTDFLKENYNITPVQTIAGTLMTSFNGNGFSITLLNATKATKALQSDFEEIKSVLDLLNAFTNAPGWPIADFEKTSAPSVNDDLLHNEVTAKAVGTYDFDKFAEWMKSGAEQVIKSEPHITELDNQVGDGDCGYTLVAGVKGITENLDKLSKDSLSQAVAQISDFIEGSMGGTSGGLYSILLSGFSHGLIQVCKSKDEPVTKEIVAKSLGIALDTLYKYTKARKGSSTMIDALEPFVKEFTASKDFNKAVKAAEEGAKSTATFEAKFGRASYVGDSSQVEDPGAVGLCEFLKGVQSAL

SEQ ID NO: 1472 - protein, 456 aa, Saccharomyces cerevisiae
MSSSQQIAKNARKAGNILKTISNEGRSDILYKIHDALKANAHAIEEANKIDLAVAKETGLADSLLKRLDLFKGDKFEVMLQGIKDVAELEDPVGKVKMARELDDGLTLYQVTAPVGVLLVIFESRPEVIANITALSIKSGNAAILKGGKESVNTFREMAKIVNDTIAQFQSETGVPVGSVQLIETRQDVSDLLDQDEYIDLVVPRGSNALVRKIKDTTKIPVLGHADGICSIYLDEDADLIKAKRISLDAKTNYPAGCNAMETLLINPKFSKWWEVLENLTLEGGVTIHATKDLKTAYFDKLNELGKLTEAIQCKTVDADEEQDFDKEFLSLDLAAKFVTSTESAIQHINTHSSRHTDAIVTENKANAEKFMKGVDSSGVYWNASTRFADGFRYGFGAEVGISTSKIHARGPVGLDGLVSYQYQIRGDGQVASDYLGAGGNKAFVHKDLDIKTVTL

SEQ ID NO: 1473 - protein, 112 aa, Oryza sativa
MALAKAKETVASAPVVVYSKSYCPFCVRVKKLFEQLGATFKAIELDGESDGSELQSALAEWTGQRTVPNVFINGKHIGGCDDTLALNNEGKLVPLLTEAGAIASSAKTTITA

SEQ ID NO: 1474 - protein, 183 aa, Xenopus laevis
MQAGLSLVCLVLLCSALGEAVLKKPKKQAGTTDTKTDQEPAPIKTKGLKTLDRGWGESIEWVQTYEEGLAKARENNKPLMVIHHLEDCPYSIALKKAFVADRMAQKLAQEDFIMLNLVHPVADENQSPDGHYVPRVIFIDPSLTVRSDLKGRYGNKMYAYDADDIPELITNMKKAKSFLKTEL

SEQ ID NO: 1475 - protein, 185 aa, Xenopus laevis
MQTGLSLACLVLLCSVLGEAALRKPKRQAGATDTNGAAKSEPAPVKTKGLKTLDRGWGEDIEWAQTYEEGLAKARENNKPLMVIHHLEDCPYSIALKKAFVADKMAQKLAQEDFIMLNLVHPVADENQSPDGHYVPRVIFIDPSLTVRSDLKGRYGNKLYAYDADDIPELITNMKKAKSFLKTEL

SEQ ID NO: 1476 - protein, 466 aa, Helicobacter pylori
MLSVYEKVNALDKRAIEELFLSEDILMENAAMALERAVLQNASLGAKVIILCGSGDNGGDGYALARRLVGRFKTLVFEMKLAKSPMCQLQQERAKKAGVVIKAYEENALNQNLECDVLIDCVIGSHFKGKLEPFLNFESLSQKARFKIACDIPSGIDSKGRVDKGAFKADLTISMGAIKSCLLSDRAKDYVGELKVGHLGVFNQIYEIPTDTFLLEKSDLKLPLRDRKNAHKGDYGHAHVLLGKHSGAGLLSALSALSFGSGVVSVQALECEITSNNKPLELVFCENFPNLLSAFALGMGLENIPKDFNKWLELAPCVLDAGVFYHKEVLQALEKEVILTPHPKEFLSLLKLVGINISMLELLDNKLEIARDFSQKYPKVVLLLKGANTLIAHQGQVFINILGSVALAKAGSGDVLAGLILSLLSQNYTPLDAAINASSAHALASLEFKNNYALTPLDLIEKIKQL

SEQ ID NO: 1477 - protein, 143 aa, Leiostomus xanthurus
SLSATDKARVKALWDKIEGKSAELGAEALGRMLVSFPQTKIYFSEWGQDLGPQTPQVRNHGAVIMAAVGKAVKSIDNLVGGLSQLSELHAFKLRVDPANFKILAHNIILVISMYFPGDFTPEVHLSVDKFLACLALALSEKYR

SEQ ID NO: 1478 - protein, 73 aa, Macaca mulatta
VAKEPSTKGLNPNPSHQMTKRKRMVLVKERKAAQTLSAILLAFIITWTPYNIMVLVSTFCDKCVPVTLWHLGY

SEQ ID NO: 1479 - protein, 60 aa, Macaca mulatta
HQMTKRKRMVLVKERKAAQTLSAILLAFIITWTPYNIMVLVSTFCDKCVPVTLWHLGYWL

SEQ ID NO: 1480 - protein, 262 aa, Lactococcus lactis
MSQLQEMMTVVSQREVAYNIFEMVLKGTLVDEMDLPGQFLHLAVPNGAMLLRRPISISSWDKRAKTCTILYRIGDETTGTYKLSKLESGAKVDVMGPLGNGFPVAEVTSTDKILIIGGGIGVPPLYELAKQLEKTGCQMTILLGFASENVKILENEFSNLKNVTLKIATDDGSYGTKGHVGMLMNEIDFEVDALYTCGAPAMLKAVAKKYDQLERLYISMESRMACGIGACYACVEHDKEDESHALKVCEDGPVFLGKQLSL

SEQ ID NO: 1481 - protein, 371 aa, Neisseria meningitidis
MKIVIAPDSFKESLTAQQVAEAIKRGFQQSIADVECLLCPVGDGGEGTVDAIRHSLDLEEKCLQVTGSFGQKEVMRYFQKEQLALFEVADLVGLGKIPLEKRNPLQIQTRGIGELIRHLISQEIKEIYIGVGGTASNDGGIGIAAGLGYQFYDEDGNALPACGQSLLNLASVSTENRYKIPEDVHIRILADVVSPLCGHQGATYTFGKQKGLDSTMFEVVDQAIQDFYEKVSPATLKLKGAGAGGGIAGGLCAFAQASIVSGIDTCLDLIDFDKKVSDVDLVIVGEGRLDRQSLAGKAPIGVAKRTPVGVPVVAICGSLVEDLPSLPFENIQAAFSILEKSEPLEDSLKNASLYLEHTASNIGHLLNMPKI

SEQ ID NO: 1482 - protein, 323 aa, Arabidopsis thaliana
MVKATKAEKKIAYDTKLCQLIDEYTQILVVAADNVGSTQLQNIRKGLRGDSVVLMGKNTMMKRSVRIHSENSGNTAILNLLPLLQGNVGLIFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATDYTFPQAEKVKEFLKDPSKFVVAAAAVSADAGGGSAQAGAAAKVEEKKEESDEEDYEGGFGLFDEE

SEQ ID NO: 1483 - protein, 953 aa, Bos taurus
MDNLLPQSRFSYFKKYPIHAIRKYLSMLRNQKEEEQVARFQKIPNAENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLMPPECHCVREGKLEHTLARDLVPGDTVCLSVGDRVPADLRLFEAVDLSVDESSLTGETTPCSKVTAPQPAATNGDLASRSNIAFMGTLVRCGKAKGIVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLRAEVTGVGYNPFGEVIVDGDVVHGFYNPSVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYHSKGQTLTLTQQQRDLYQQEKAQMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNKMFCYAVLGSIMGQLLVIYFPPLQKVFQTESLSILDLLFLLGLTSSVCIVAEIIKKVERSREKIQKPVSSTSSSFLEV

SEQ ID NO: 1484 - protein, 470 aa, Arabidopsis thaliana
MAATATEKLPQLKSAVDGLTEMSENEKSGFINLVSRYLSGEAQHIEWSKIQTPTDEIVVPYDKMANVSEDASETKYLLDKLVVLKLNGGLGTTMGCTGPKSVIEVRDGLTFLDLIVIQIENLNNKYNCKVPLVLMNSFNTHDDTQKIVEKYTKSNVDIHTFNQSKYPRVVADEFVPWPSKGKTDKDGWYPPGHGDVFPSLMNSGKLDAFLSQGKEYVFIANSDNLGAIVDLKILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKATSDLLLVQSDLYTLVDGFVTRNKARTNPTNPAIELGPEFKKVASFLSRFKSIPSIVELDSLKVSGDVWFGSGVVLKGKVTVKANAGTKLEIPDNAVLENKDINGPEDL

SEQ ID NO: 1485 - protein, 520 aa, Cavia porcellus
MNSKCDVVVVGGGISGLAAAKLLHDSGLNVVVLEARDCVGGRTYTLRNQNVKYVDLGGAYVGPTQNRILRLAKELGLETYRVNDVERQIHHVKGKSYPFRGPFPPAWNPISYLDHNNLWRTMDDMGKEIPSDAPWKAPLAEEWDHMTMKELLNKICWTNCPRQFGTLFVNLCFTAETHEVSALWFLWYVKQCGGTTRIISTTNGGQERKFVGGSGQISERIMNLLGDRVKLQRPVVYIDQTGESVLVETLNHEIYEAKYVISAIPPALGMKIHFKPPLPMMKNQLVSRVPLGSVIKCIVYYKDPFWRKKDFCGTMVIEGEEAPVLYTMDDTKPDGSYAAIIGFIAAHKARKLARLTKEERLKKLCELYAKVLGSKEALKPVHYEEKNWCEEQYSGGCYTAYFPPGIMTQYGRFLRQPVGRIFFAGTETATHWSGYMEGAVEAGERAAREVLNAIGKIPEDEIWQPEPESVDVPAQPITTTFLERHLPSVPGLLRLIRLTTVVSAVALGFLAQKRGLLLRI

SEQ ID NO: 1486 - protein, 497 aa, Arabidopsis thaliana
MEMIIISLCLATILALLLLKQFLNRTYTAKVNLPPSPWRVPVIGNLHQLSLHPHRSLRSLSHRYGPLMLLHFGRVPVLVVSSSDVAHDLMKTHDLKVANRPQLKVVEKIFNGGREMVFSPYGEYWRQIKSVCIVNLLNKKKVQSFEKVREEEISEMMERVEKASSDSSPLNLSELLLTLTSDVTSRVSLGRKYSKEESMSDFKIQMRKITELVGGFPVGEYIPCLAWIDKLRGVDEKAEEVSKAFGDLMEKVLQEHLDATDKPTLDFVDVLLSLERHERNGVQIRRSDIKFLILDMFLAGTETTYALLEWIMTELIRHPECMKKLQDEIRAKATKLILYISEEDVEDMKYLKAVVKEVLRLHPPLPLLVPRELSEDIKLKGYDIAAGTQVIINAWAIQRDTMTWGIDAEEFRPERHLDSLVDFRGTNFEFIPFGSGRRICPGIGFAMALVEVTLANLVNRFNWRMEVQHSGDEYDLAESTGLDVCRKFPLIVFPSPA

SEQ ID NO: 1487 - protein, 496 aa, Arabidopsis thaliana
MSLWYIIVVFVFFASIFIAKNTRKTKKNLPPGPPRLPIIGNLHQLGSKPHRSMFKLSEKYGPLVYLKLGKVPSVVASTPETVKDVLKTFDKDCCSRAFLTYPARISYNLKDLAFAPYSKYWKAVRKMTVVELYTAKRVKSFRNIREEEVASFVEFIKHSASLEEIVNLNQTLVKLSGSVICRVGFGINLEGSKLENTYEEVIHGTMEVLGSFAASDYFPVIGGIIDRITGLHNKCEKVFKGTDSFFDHCIKHHLEDGGSKDDIVDLLLKVERGEIGLGEFQFTRNHTKGILLDILLAGVDTSGHTITWVMTHLIKNPRVMKKAQAEVREVIKNKDNITEEDIEGLEYLKMVVKETLRINPLVPLLTPREASKDVKIGGYNIPKKTWIHVNIWAIHRNPNVWKDPEAFIPERFMDNQIDYKGLNFELLPFGSGRRICPGIGMGMALIHLTLINLLYRFDWKLPEGMEVEDVDLEESYGLVCPKKVPLELIPVLTQWT

SEQ ID NO: 1488 - protein, 496 aa, Arabidopsis thaliana
MIWWFIVGASFFFAFILIAKDTRTTKKNLPPGPPRLPIIGNLHQLGSKPQRSLFKLSEKYGSLMSLKFGNVSAVVASTPETVKDVLKTFDAECCSRPYMTYPARVTYNFNDLAFSPYSKYWREVRKMTVIELYTAKRVKSFQNVRQEEVASFVDFIKQHASLEKTVNMKQKLVKLSGSVICKVGFGISLEWSKLANTYEEVIQGTMEVVGRFAAADYFPIIGRIIDRITGLHSKCEKVFKEMDSFFDQSIKHHLEDTNIKDDIIGLLLKMEKGETGLGEFQLTRNHTKGILLNVLIAGVDTSGHTVTWVMTHLIKNPRVMKKAQAEVREVIKNKDDITEEDIERLEYLKMVIKETLRINPLVPLLIPREASKYIKIGGYDIPKKTWIYVNIWAVQRNPNVWKDPEVFIPERFMHSEIDYKGVDFELLPFGSGRRMCPGMGLGMALVHLTLINLLYRFDWKLPEGMNIEDVDLEESYGLVCPKKVPLQLIPVLTQWT

SEQ ID NO: 1489 - protein, 492 aa, Xenopus laevis
  MOD_RES (327)..(327): Any amino acid
MVKLPSLTPYWPLIRFLVPLGITNIAIDFGEQALNRGIAAVKEDAIEMLASYGLAYSLMKFFTGPMSDFKNVGLVFVNSKRDRMKAVLCMVVAGIIAAVFHTLIAYSDLGYYIINKLHHVDESVGGKTRKAFLYLAAVPFMDAMAWTHAGILLKHKYSFLVGCASISDVIAQVVFVAILLHSHLECREPLLIPILSLYIGALVRCTTLCLGYYKNIHDKIPESSGPEIGGDATIKKMLSFWWPLALILATQRISRPIVNLFVSRDLGGSTAATEAVAILTATYPVGHMPYGWLTEIRAVYPAFDKSNPGSKLANSSNPVSKTHIKNXTFACMALSLTLCFVMFWTPNVSEKILVDIIGVDFAFAELCVIPLRIFSFFPVPVTVRAHLTGWLMTLKKTFVLAPSSILRIIVLISSLIVLPYLGVHGATLGVGSLLAGFVGESTMVAIASLYVYRKQKKKSETENAVEGEDSAMTDLPHNEELTDIVEIKEDGE

SEQ ID NO: 1490 - protein, 501 aa, Danio rerio
MMKFPALTHYWPLIRFLVPLAITNIAIDLGEQALNRGIAAVKEDAVEMLASYGLAYSLMKFFTGPMSDFKNVGLVFVNSKRDRTKAVLCMVVAGTVAIVFHTLIAYTNLGYYIINKLHHVDESVGSKTRKAFLYLAAFPLLDAMAWTHAGILLKHKHSLLVGCASISDVVAQIVFVGILLHSHLECVEPMLIPILSLYMGALVRFTIVGLGYYKVIHDNIPESSGPEVGGDATIKKMLSFWWPLALILATQRISRPIVNLFVSRDLKGSTAATEAVAVLTATYPVGHMPYGWLTELRAVYPAFDKNNPSNKLINSGTVVTKSHIKRFTFFCLALSITLCFMVFWAPHISESILVDIIGVDHAFAELCITPLRIFSFFPIPVTIRAHLTGWLMTLKKTFVLAPSSVLRIIVLISSLIVLPYMGVHGATLGVGSLLAGFLGESTMVAIAACYVYRKQKKKKDSDEDMTIDGEDSAPMNEVRSRGRMDDIVELREEDEEELDED

SEQ ID NO: 1491 - protein, 94 aa, Danio rerio
AHLTGWLMTLKKTFVLAPSSVLRIIVLISSLIVLPYMGVHGATLGVGSLLAGFLGESTMVAIAACYVYRKQKKKKDSDEDMTIDGEDSAPMNEV

SEQ ID NO: 1492 - protein, 74 aa, Danio rerio
HLTGWLMTLKKTFVLAPSSVLRIIVLISSLIVLPYMGVHGATLGVGSLLAGFLGESTMVAIAACYVYRKQKKKK

SEQ ID NO: 1493 - protein, 126 aa, Tetraodon nigroviridis
IKKMLSFWWPLALILATQRISRPIVNLFVSRDLKGTSEATEAVAVLTATYPVGHMPYGWLTELRAVYPAFDKNNPSNKINASSPVTKSHIKKFTFCCLALSLMLCFVLFWTPHVSEKILVDVIGVD

SEQ ID NO: 1494 - protein, 39 aa, Tetraodon nigroviridis
VTKSHIKKFTFCCLALSLMLCFVLFWTPHVSEKILVDVI

SEQ ID NO: 1495 - protein, 185 aa, Mus musculus
LYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRK

SEQ ID NO: 1496 - protein, 196 aa, Mus musculus
PGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEK

SEQ ID NO: 1497 - protein, 198 aa, Mus musculus
LLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAATNVLRETWLVYKHTKLLKKIDHAKVRKHQRKFLQAIHQLRGVKMEQRKLSDQANTLVDLSKMQNVMYDLITELNDRSEDLEKQIGSLE

SEQ ID NO: 1498 - protein, 76 aa, Mus musculus
FLGAMWLISITFLSIGYGDMVPHTYCGKGVCLLTGIMGAGCTALVVAVVARKLELTKAEKHVHNFMMDTQLTKRIK

SEQ ID NO: 1499 - protein, 197 aa, Sus scrofa
LVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLE

SEQ ID NO: 1500 - protein, 99 aa, Sus scrofa
VTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKL

SEQ ID NO: 1501 - protein, 192 aa, Arabidopsis thaliana
MEEKKTESTNKNVKKANLLDHHSIKHILDESVSDIVTSRGYKEDVRLSNLKLILGTIIIVVALVAQFYNKKFPENRDFLIGCIALYVVLNAVLQLILYTKEKNAILFTYPPEGSFTSTGLVVSSKLPRFSDQYTLTIDSADPKSISAGKSVQLTKSVTQWFTKDGVLVEGLFWKDVEALIKNYAEEEPKKKK

SEQ ID NO: 1502 - protein, 105 aa, Drosophila melanogaster
VWKSNTVRKIANELLTLEGQVKDLLTLKNCPNFNCFVIKKHVAAIGQFVISIYFCLCQENSYPKILKILCCLPSVGLQLIIMHFHTEIILVYRYVWLVNETLEDS

SEQ ID NO: 1503 - protein, 99 aa, Drosophila melanogaster
VTTFFTISVLLLMNVWKSNTVRKIANELLTLEGQVKDLLTLKNCPNFNCFVIKKHVAAIGQFVISIYFCLCQENSYPKILKILCCLPSVGLQLIIMHFH

SEQ ID NO: 1504 - protein, 395 aa, Drosophila melanogaster
MLLKFMYIYGIGCGLMPAPLKKGQFLLGYKQRWYLIYTACLHGGLLTVLPFTFPHYMYDDSYMSSNPVLKWTFNLTNITRIMAMFSGVLLMWFRRKRILNLGENLILHCLKCKTLDNRSKKYSKLRKRVRNVLFQMLLVANLSILLGALILFRIHSVQRISKTAMIVAHITQFIYVVFMMTGICVILLVLHWQSERLQIALKDLCSFLNHEERNSLTLSENKANRSLGKLAKLFKLFAENQRLVREVFRTFDLPIALLLLKMFVTNVNLVYHGVQFGNDTIETSSYTRIVGQWVVISHYWSAVLLMNVVDDVTRRSDLKMGDLLREFSHLELVKRDFHLQLELFSDHLRCHPSTYKVCGLFIFNKQTSLAYFFYVLVQVLVLVQFDLKNKVEKRN

SEQ ID NO: 1505 - protein, 111 aa, Mus musculus
KTKERINSTLRCKVNKAGHASVKVNLNLVMLFPFSVSLVSFLLLILSLWRHTRQIQLSVTGYKDPSTTAHVKAMKAVISFLALFVVYCLAFLIATSSYFMPESELAVIWGE

SEQ ID NO: 1506 - protein, 150 aa, Mus musculus
KTKERINSTLRCKVNKAGHASVKVNLNLVMLFPFSVSLVSFLLLILSLWRHTRQIQLSVTGYKDPSTTAHVKAMKAVISFLALFVVYCLAFLIATSSYFMPESELAVIWGELIALIYPSSHSFILILGSSKLKQASVRVLCRVKTMLKGK

SEQ ID NO: 1507 - protein, 159 aa, Oncorhynchus mykiss
MEKLTEKEKELIRVSWESLGKDKVPHGVIMFSRLFELEPALLNLFHYNTNCGTIQDCLSSPEFLDHVTKVMLVIDAAVSHLDNLHTLEDFLLNLGKKHQAVGVNTQSFAVVGESLLYMLQCSLGQGYTAPLRQAWLNMYTIVVAAMSRGWAKNGEHKTD

SEQ ID NO: 1508 - protein, 131 aa, Staphylococcus aureus
MHKVQLIIKLLLQLGIIIVITYIGTEIQKIFHLPLAGSIVGLFLFYLLLQFKIVPLTWVEDGANFLLKTMVFFFIPSVVGIMDVASEITLNYILFFAVIIIGTCIVALSSGYIAEKMSVKHKHRKGVDAYE

SEQ ID NO: 1509 - protein, 333 aa, Rattus norvegicus
MTSKSHWKLLALALVLVVVMVWYSISREDRYIEFFYFPVSEKKEPCFQGEAERQASKIFGNHSREQPIFLQLKDYFWVKTPSAYELPFGTKGSEDLLLRVLAITSYSIPESIQSLECRRCVVVGNGHRLKNSSLGGVINKYDVVIRLNNAPVAGYEGDVGSKTTIRLFYPESAHFDPKIENNPDTLLVLVAFKAMDFHWIETILSDKKRVRKGFWKQPPLIWDVNPKQIRILNPFFMEIAADKLLSLPIQQPRKIKQKPTTGLLAITLALHLCDLVHIAGFGYPDAYNKKQTIHYYEQITLKSMAGSGHNVSQEAVAIKRMLEMGAVKNLTYF

SEQ ID NO: 1510 - protein, 394 aa, Mus musculus; identical to SEQ ID NO: 95

SEQ ID NO: 1511 - protein, 192 aa, Mus musculus
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 1512 - protein, 200 aa, Mus musculus
MGNGLSDQTSILSSLPSFQSFHIVILGLDCAGKTTVLYRLQFNEFVNTVPTKGFNTEKIKVTLGNSKTVTFHFWDVGGQEKLRPLWKSYTRCTDGIVFVVDSVDVERMEEAKTELHKITRISENQGVPVLIVANKQDLRNSLSLSEIEKLLAMGELSSSTPWHLQPTCAIIGDGLKEGLEKLHDMIIKRRKMLRQQKKKR

SEQ ID NO: 1513 - protein, 200 aa, Rattus norvegicus; identical to SEQ ID NO: 1512

SEQ ID NO: 1514 - protein, 359 aa, Pan troglodytes
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 1515 - protein, 84 aa, Pan troglodytes
SMLNDSVLWIPAFMVKGGEKHVEWVNALILKNKLKVRTAYPSLRLIHAVRGYWLTNKVPIKRPSTGLLMYTLATRFCDEIHLYG

SEQ ID NO: 1516 - protein, 79 aa, Pan troglodytes
MLNDSVLWIPAFMVKGGEKHVEWVNALILKNKLKVRTAYPSLRLIHAVRGYWLTNKVPIKRPSTGLLMYTLATRFCDEI

SEQ ID NO: 1517 - protein, 312 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 1518 - protein, 147 aa, Pan troglodytes
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTAVASALSSRYH

SEQ ID NO: 1519 - protein, 147 aa, Pan troglodytes
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 1520 - protein, 147 aa, Hylobates lar
MGHFTEEDKATITSLWGKVNVEDAGGETLGRLLVVYPWTQRFFDSFGNLSSASAIMGNPKVKAHGKKVLTSLGGAIKNLDDLKGTFAQLSELHCDKLHVDPENFRLLGNVLVTVLAIHFGKEFTPEVQASWQKMVAGVASALSSRYH

SEQ ID NO: 1521 - protein, 147 aa, Hylobates lar
MGHFTEEDKATITSLWGKVNVEDVGGETLGRLLVVYPWTQRFFDSFGNLSSASAIMGNPKVKAHGKKVLTSLGGAIKNLDDLKGTFAQLSELHCDKLHVDPENFRLLGNVLVTVLAIHFGKEFTPEVQASWQKMVAGVASALSSRYH

SEQ ID NO: 1522 - protein, 778 aa, Gallus gallus
MPVQVLKIIKGKPETQLPSHLQREDLKHLQTGLDHTNKYFQGIVILSYPLTKLGDGTDFFKIVLQDDTCSRINSINVLMYGKMAEDCAKLIRNGDTFIVAGFKVAESPTAREDGRHACHLQVSEESGSAIFICTQPSITPFSEATSPSVAPKYVYTPLNCLKDGTVVNLYGIVKFFKPPYISKGTDYCSVVTLVDQSNVKLTCTLFNGNLDSLPKIYKNGDIVRFHRVKIREYNGQMQGITSAGFASLTFDGTVGAPVVPRASSKVYTFVDEEQKTVEELRIWAASNLSVSGPEAKLSDVKPMMFFDLTCQLVGKAKVDGSSFLLKVWDGTKCPYPTWKVPVEAKELEGDRVLLHHLRNLTVDVLVYDNHVQLAKSLKTGSFLRIYSIHTKQASAKNEDMSSHIEFHLHGGTCYGRGIGILPENNPDVEELKSFLECVELTDSQNMESVSSLELGDTFDSYTDLESPLQRCQQLSATVLTDHQDMSNTVLKTVLNSSAPQQYRIRAKLRSFKPQKLYQSVKLHCSKCNTLQEVPNGDAIDFILQGCAATAPNPELQSMSWYESVVWTTEEDQGRKITIHFVKHYEMLQRPENTLLMIEGGTLKEIWKLTRRFKCVIPVKSKEDDLELLDLSAPFLLQGNIKYYGCKKCSTPKSIKNLSSLAEKREPSWEPTEIAQVLGIEPLQYVFVMKFTLVDGTGVLNAYLFDYEKFFQIPASEILTNSFLQQKMEMTMNTLSPPGRKLDDLPWLECFIKSYNVADGMKHQVYYQIFDTTVAEDVV

SEQ ID NO: 1523 - protein, 76 aa, Escherichia coli
RVKQLSGANSGEKSKITIPWFAILFIVVAIFNSFHLLPQSVVNMLVTLDTFLLAMAMAALGLTTHVSALKKAGAKP

SEQ ID NO: 1524 - protein, 74 aa, Escherichia coli
VKQLSGANSGEKSKITIPWFAILFIVVAIFNSFHLLPQSVVNMLVTLDTFLLAMAMAALGLTTHVSALKKAGAK

SEQ ID NO: 1525 - protein, 147 aa, Gorilla gorilla
MGHFTEEDKATITSLWGKVNVEDAGGETLGRLLVVYPWTQRFFDSFGNLSSASAIMGNPKVKAHGKKVLTSLGGAIKHLDDLKGTFAQLSELHCDKLHVDPENFRLLGNVLVTVLAIHFGKEFTPEVQASWQKMVTAVASALSSRYH

SEQ ID NO: 1526 - protein, 147 aa, Gorilla gorilla; identical to SEQ ID NO: 1519

SEQ ID NO: 1527 - protein, 937 aa, Rattus norvegicus
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 1528 - protein, 951 aa, Rattus norvegicus
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 1529 - protein, 192 aa, Bos taurus
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 1530 - protein, 192 aa, Canis familiaris; identical to SEQ ID NO: 1529

SEQ ID NO: 1531 - protein, 192 aa, Mus musculus; identical to SEQ ID NO: 1529

SEQ ID NO: 1532 - protein, 937 aa, Bos taurus
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKESDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 1533 - protein, 401 aa, Mus musculus
MQVSIACTEHNLKSRNGEDRLLSKQSSNAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 1534 - protein, 401 aa, Rattus norvegicus
MQVSIACTEHNLKSRNGEDRLLSKQSSTAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 1535 - protein, 332 aa, Staphylococcus aureus
MTKITVFGMGSFGTALANVLAENGHDVLMWGKNQDAVDELNTCHTNKKYLKYAKLDVNIIATSDMTKAIQFADIYLMALPTKAMREVATQINDKLTSKKTFIHVAKGIENGTFKRVSEMIEDSISPEYNAGIGVLSGPSHAEEVVVKQPTTVAASSKDKSVSKLTQDLFMNDYLRVYTNDDLIGVELGGALKNIIAVASGIVAGIGYGDNAKAALMTRGLAEISRLGEKLGADPMTFLGLGGIGDLIVTCISTHSRNFTLGYKLGQGESMDQALSEMNMVVEGIYTTKSVYHLAKEKNVDMPITNALYRVLFENISVKECVKDLMERDKKSE

SEQ ID NO: 1536 - protein, 332 aa, Staphylococcus aureus; identical to SEQ ID NO: 1535

SEQ ID NO: 1537 - protein, 292 aa, Staphylococcus aureus
MSQDVNELSKQPTPDKAEDNAFFPSPYSLSQYTAPKTDFDGVEHKGAYKDGKWKVLMIAAEERYVLLENGKMFSTGNHPVEMLLPLHHLMEAGFDVDVATLSGYPVKLELWAMPTEDEAVISTYNKLKEKLKQPKKLADVIKNELGPDSDYLSVFIPGGHAAVVGISESEDVQQTLDWALDNDRFIVTLCHGPAALLSAGLNREKSPLEGYSVCVFPDSLDEGANIEIGYLPGRLKWLVADLLTKQGLKVVNDDMTGRTLKDRKLLTGDSPLASNELGKLAVNEMLNAIQNK

SEQ ID NO: 1538 - protein, 292 aa, Staphylococcus aureus; identical to SEQ ID NO: 1537

SEQ ID NO: 1539 - protein, 412 aa, Staphylococcus aureus
MNDLIINHIAELILPKSTDKPLKGKELDELNVVKNGTVVIKDGKIVYAGQHTDDYDATETIDASGKVVSPALVDAHTHLTFGGSREHEMSLKRQGKSYLEILEMGGGILSTVNATRETSEDDLFKKAEHDLLTMIKHGVLAVESKSGYGLDRENELKQLKVSNRLAEKYDLDMKHTFLGPHAVPKEASSNEAFLEEMIALLPEVKQYADFADIFCETGVFTIEQSQHYMQKAKEAGFKVKIHADEIDPLGGLELAIDEQAISADHLVASSDKGKEKLRNSDTVAVLLPATTFYLGKEDYADARGMLDNNGAIALATDYNPGSSVTNNLQLVMAIAALKLKLSPSEVWNAVTVNAAKAIDINAGTINTGDKANLVIWDAPNHEYIPYHFGINHAEKVIKDGKVIVDNTLSFKA

SEQ ID NO: 1540 - protein, 319 aa, Staphylococcus aureus
MKTFGKKVVLIGDGSVGSSYAFAMVTQGVADEFVIIDIAKDKVKADVQDLNHGTVHSPSPVDVKAGEYEDCKDADLVVITAGAPQKPGETRLQLVEKNTKIMKSIVKSVMDSGFDGYFLIAANPVDILTRFVKEYTGLPAERVIGSGTVLDSARLQYLISQELGVAPSSVDASIIGEHGDTELAVWSQANVAGISVYDTLKEQTGSEAKAEEIYVNTRDAAYEIIQAKGSTYYGIALALMRISKAILNNENNVLNVSIQLDGQYGGHKGVYLGVPTLVNQHGAVKIYEMPLSAEEQALFDKSVKILEDTFDSIKYLLED

SEQ ID NO: 1541 - protein, 492 aa, Staphylococcus aureus
MTTQHSKTDVILIGGGIMSATLGTLLKELSPEKNIKVFEKLAQPGEESSNVWNNAGTGHSALCELNYTKEGKDGTVDCSKAIKINEQYQISKQFWAYLVKTGQLDNPDRFIQAVPHMSFVIGEDNVAFIKSRVATLKKSVLFEKMKLSQDEEEMKSWVPLMIEGRKSDEPIALTYDETGTDVNFGALTAKLFENLEQRGVGIQYKQNVLDIKKQKSGAWLVKVKDLETNETTTYESDFVFIGAGGASLPLLQKTGIKQSKHIGGFPVSGLFLRCTNQEVIDRHHAKVYGKAAVGAPPMSVPHLDTRFVDGKRSLLFGPFAGFSPKFLKTGSHMDLIKSVKPNNIVTMLSAGIKEMSLTKYLVSQLMLSNDERMDDLRVFFPNAKNEDWEVITAGQRVQVIKDTEDSKGNLQFGTEVITSDDGTLAALLGASPGASTAVDIMFDVLQRCYRDEFKGWEPKIKEMVPSFGYRLTDHEDLYHKINEEVTKYLQVK

SEQ ID NO: 1542 - protein, 492 aa, Staphylococcus aureus; identical to SEQ ID NO: 1541

SEQ ID NO: 1543 - protein, 494 aa, Staphylococcus aureus
MDASTLFKKVKVKRVLGSLEQQIDDITTDSRTAREGSIFVASVGYTVDSHKFCQNVADQGCKLVVVNKEQSLPANVTQVVVPDTLRVASILAHTLYDYPSHQLVTFGVTGTNGKTSIATMIHLIQRKLQKNSAYLGTNGFQINETKTKGANTTPETVSLTKKIKEAVDAGAESMTLEVSSHGLVLGRLRGVEFDVAIFSNLTQDHLDFHGTMEAYGHAKSLLFSQLGEDLSKEKYVVLNNDDSFSEYLRTVTPYEVFSYGIDEEAQFMAKNIQESLQGVSFDFVTPFGTYPVKSPYVGKFNISNIMAAMIAVWSKGTSLETIIKAVENLEPVEGRLEVLDPSLPIDLIIDYAHTADGMNKLIDAVQPFVKQKLIFLVGMAGERDLTKTPEMGRVACRADYVIFTPDNPANDDPKMLTAELAKGATHQNYIEFDDRAEGIKHAIDIAEPGDTVVLASKGREPYQIMPGHIKVPHRDDLIGLEAAYKKFGGGPVDQ

SEQ ID NO: 1544 - protein, 494 aa, Staphylococcus aureus; identical to SEQ ID NO: 1543

SEQ ID NO: 1545 - protein, 230 aa, Staphylococcus aureus
MKDLPIIALDFESKEKVNQFLDLFDESLFVKVGMELFYQEGPQLINEIKERGHDVFLDLKLHDIPNTVGKAMEGLAKLNVDLVNVHAAGGVKMMSEAIKGLRKHNQHTKIIAVTQLTSTTEDMLRHEQNIQTSIEEAVLNYAKLANAAGLDGVVCSPLESRMLTEKLGTSFLKVTPGIRPKGASQDDQHRITTPEEARQLGSTHIVVGRPITQSDNPVESYHKIKESWLV

SEQ ID NO: 1546 - protein, 272 aa, Staphylococcus aureus
MKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 1547 - protein, 309 aa, Staphylococcus aureus
MAKTYIFGHKNPDTDAISSAIIMAEFEQLRGNSGAKAYRLGDVSAETQFALDTFNVPAPELLTDDLDGQDVILVDHNEFQQSSDTIASATIKHVIDHHRIANFETAGPLCYRAEPVGCTATILYKMFRERGFEIKPEIAGLMLSAIISDSLLFKSPTCTQQDVKAAEELKDIAKVDIQKYGLDMLKAGASTTDKSVEFLLNMDAKSFTMGDYVTRIAQVNAVDLDEVLNRKEDLEKEMLAVSAQEKYDLFVLVVTDIINSDSKILVVGAEKDKVGEAFNVQLEDDMAFLSGVVSRKKQIVPQITEALTK

SEQ ID NO: 1548 - protein, 309 aa, Staphylococcus aureus; identical to SEQ ID NO: 1547

SEQ ID NO: 1549 - protein, 328 aa, Staphylococcus aureus
MADLLNVLKDKLSGKNVKIVLPEGEDERVLTAATQLQATDYVTPIVLGDETKVQSLAQKLDLDISNIELINPATSELKAELVQSFVERRKGKATEEQAQELLNNVNYFGTMLVYAGKADGLVSGAAHSTGDTVRPALQIIKTKPGVSRTSGIFFMIKGDEQYIFGDCAINPELDSQGLAEIAVESAKSALSFGMDPKVAMLSFSTKGSAKSDDVTKVQEAVKLAQQKAEEEKLEAIIDGEFQFDAAIVPGVAEKKAPGAKLQGDANVFVFPSLEAGNIGYKIAQRLGGYDAVGPVLQGLNSPVNDLSRGCSIEDVYNLSIITAAQALQ

SEQ ID NO: 1550 - protein, 38 aa, Mycobacterium tuberculosis
LSTAIVEPKYWGGVCLNVGCIPSKALLRNAELVHIFTK

SEQ ID NO: 1551 - protein, 43 aa, Mycobacterium tuberculosis
LSTAIVEPKYWGGVCLNVGCIPSKALLRNAELVHIFTKDAKAF

SEQ ID NO: 1552 - protein, 200 aa, Staphylococcus aureus
MYAYVKGKLTHLYPTHVVVETAGVGYEIQTPNSYRFQKHLDHEVLIRTSLIVREDAQLLYGFSSEEEKDMFLSLIKVTGIGPKSALAILATSTPNEVKRAIENENDTYLTKFPGIGKKTARQIVLDLKGKVKITEEDSDSLLQVDATSTVQDQFVQEAMLALEALGYSKRELAKVEKTLNKNKYDSVDEAVKAGLQLVVS

SEQ ID NO: 1553 - protein, 279 aa, Streptococcus pyogenes
MGTIKIVTDSSITIEPELIKALDITVVPLSVMIDSKLYSDNDLKEEGHFLSLMKASKSLPKTSQPPVGLFAETYENLVKKGVTDIVAIHLSPALSGTIEASRQGAEIAEAPVTVLDSGFTDQAMKFQVVEAAKMAKAGASLNEILAAVQAIKSKTELYIGVSTLENLVKGGRIGRVTGVLSSLLNVKVVMALKNDELKTLVKGRGNKTFTKWLDSYLAKNSHRPIAEIAISYAGEASLALTLKERIAAYYNHSISVLETGSIIQTHTGEGAFAVMVRYE

SEQ ID NO: 1554 - protein, 345 aa, Staphylococcus aureus
MVHNKNNTILKMIKGEETSHTPVWFMRQAGRSQPEYRKLKEKYSLFDITHQPELCAYVTHLPVDNYHTDAAILYKDIMTPLKPIGVDVEIKSGIGPVIHNPIKTIQDVEKLSQIDPERDVPYVLDTIKLLTEEKLNVPLIGFTGAPFTLASYMIEGGPSKNYNFTKAMMYRDEATWFALMNHLVDVSVKYVTAQVEAGAELIQIFDSWVGALNVEDYRRYIKPHMIRLISEVKEKHDVPVILFGVGASHLINEWNDLPIDVLGLDWRTSINQAQQLGVTKTLQGNLDPSILLAPWNVIEERLKPILDQGMENGKHIFNLGHGVFPEVQPETLRKVSEFVHTYTQR

SEQ ID NO: 1555 - protein, 345 aa, Staphylococcus aureus; identical to SEQ ID NO: 1554

SEQ ID NO: 1556 - protein, 344 aa, Mycobacterium tuberculosis [sequence omitted]

SEQ ID NO: 1557 - protein, 162 aa, Ovis orientalis
IIVTQTMKGLDIQKVAGTWHSLAMAASDISLLDAQSAPLRVYVEELKPTPEGNLEILLQKWENGECAQKKIIAEKTKIPAVFKIDALNENKVLVLDTDYKKYLLFCMENSAEPEQSLACQCLVRTPEVDNEALEKFDKALKALPMHIRLAFNPTQLEGQCHV

SEQ ID NO: 1558 - protein, 180 aa, Ovis aries
MKCLLLALGLALACGVQAIIVTQTMKGLDIQKVAGTWHSLAMAASDISLLDAQSAPLRVYVEELKPTPEGNLEILLQKWENGECAQKKIIAEKTKIPAVFKIDALNENKVLVLDTDYKKYLLFCMENSAEPEQSLACQCLVRTPEVDNEALEKFDKALKALPMHIRLAFNPTQLEGQCHV

SEQ ID NO: 1559 - protein, 147 aa, Aotus azarae
MVHFTAEEKAAITSLWGKMNVEEAGGEALGRLLVVYPWTQRFFDNFGNLSSPSAILGNPKVKAHGKKVLTSFGDAIKNMDNLKTTFAKLSELHCDKLHVDPENFRLLGNVMVIILATHFGKEFTPEVQAAWQKLVSAVAIALGHKYH

SEQ ID NO: 1560 - protein, 147 aa, Alouatta belzebul; identical to SEQ ID NO: 1559

SEQ ID NO: 1561 - protein, 147 aa, Alouatta seniculus; identical to SEQ ID NO: 1559

SEQ ID NO: 1562 - protein, 147 aa, Ateles geoffroyi; identical to SEQ ID NO: 1559

SEQ ID NO: 1563 - protein, 147 aa, Brachyteles arachnoides; identical to SEQ ID NO: 1559

SEQ ID NO: 1564 - protein, 147 aa, Cacajao calvus; identical to SEQ ID NO: 1559

SEQ ID NO: 1565 - protein, 147 aa, Callicebus moloch; identical to SEQ ID NO: 1559

SEQ ID NO: 1566 - protein, 147 aa, Callicebus torquatus; identical to SEQ ID NO: 1559

SEQ ID NO: 1567 - protein, 147 aa, Callimico goeldii; identical to SEQ ID NO: 1559

SEQ ID NO: 1568 - protein, 147 aa, Chiropotes satanas; identical to SEQ ID NO: 1559

SEQ ID NO: 1569 - protein, 147 aa, Callithrix jacchus
MVHFTAEEKAAITSLWGKMNVEEAGGEALGRLLVVYPWTQRFFDNFGNLSSPSAILGNPKVKAHGKKVLTSFGDAIKNMDNLKTTFAKLSELHCDKLHVDPENFRLLGNVLVIILATHFGKEFTPEVQAAWQKLVSAVAIALGHKYH

SEQ ID NO: 1570 - protein, 147 aa, Cebuella pygmaea; identical to SEQ ID NO: 1569

SEQ ID NO: 1571 - protein, 147 aa, Saimiri sciureus
MVHFTAEEKAAITSLWSKMNVEEAGGEALGRLLVVYPWTQRFFDNFGNLSSPSAILGNPKVKAHGKKVLTSFGDAIKNMDNLKTTFAKLSELHCDKLHVDPENFRLLGNVMVIILATHFGKEFTPEVQAAWQKLVSAVAIALGHKYH

SEQ ID NO: 1572 - protein, 147 aa, Saimiri boliviensis; identical to SEQ ID NO: 1571

SEQ ID NO: 1573 - protein, 147 aa, Ateles geoffroyi
MSNFTAEDKAAITSLWGKVNVEDAGGETLGRLLVVYPWTQRFFDSFGSLSSPSAIMGNPKVKAHGVKVLTSLGEAIKNLDDLKGTFGQLSELHCDKLHVDPENFRLLGNVLVTVLAILHGKEFTPEVQASWQKMVAGVASALASRYH

SEQ ID NO: 1574 - protein, 147 aa, Ateles paniscus; identical to SEQ ID NO: 1573

SEQ ID NO: 1575 - protein, 147 aa, Lagothrix lagotricha; identical to SEQ ID NO: 1573

SEQ ID NO: 1576 - protein, 147 aa, Brachyteles arachnoides; identical to SEQ ID NO: 1573

SEQ ID NO: 1577 - protein, 147 aa, Macaca mulatta
MGHFTEEDKATITSLWGKVNVEDAGGETLGRLLVVYPWTQRFFDSFGNLSSASAIMGNPKVKAHGKKVLTSLGDAIKNLDDLKGTFAQLSELHCDKLHVDPENFRLLGNVLVTVLAIHFGKEFTPEVQASWQKMVAGVASALSSRYH

SEQ ID NO: 1578 - protein, 147 aa, Macaca fuscata; identical to SEQ ID NO: 1577

SEQ ID NO: 1579 - protein, 147 aa, Papio cynocephalus; identical to SEQ ID NO: 1577

SEQ ID NO: 1580 - protein, 485 aa, Nicotiana sylvestris
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPNSTDNAEFQLVLTIIKESLKTDPLKYTKMKERLVGVSEETTTGVKRLYQMQANGTLLFPAINVNDSVTKSKFDNLYGCRHSLPDGLMRATDVMIAGKVALVAGYGDVGKGCAAALKQAGARVIVTEIDPICALQATMEGLQVLTLEDVVSDVDIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGAKLTKLSKDQADYISVPVEGPYKPAHYRY

SEQ ID NO: 1581 - protein, 133 aa, Nicotiana sylvestris
AIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGAKLTKLSKDQADYISVPVE

SEQ ID NO: 1582 - protein, 485 aa, Nicotiana tabacum; identical to SEQ ID NO: 1580

SEQ ID NO: 1583 - protein, 133 aa, Nicotiana tabacum; identical to SEQ ID NO: 1581

SEQ ID NO: 1584 - protein, 147 aa, Thunnus thynnus
MADFDAVLKCWGPVEADYTTIGGLVLTRLFKEHPETQKLFPKFAGIAQADIAGNAAVSAHGATVLKKLGELLKAKGSHAAILKPLANSHATKHKIPINNFKLISEVLVKVMHEKAGLDAGGQTALRNVMGIIIADLEANYKELGFSG

SEQ ID NO: 1585 - protein, 147 aa, Thunnus orientalis; identical to SEQ ID NO: 1584

SEQ ID NO: 1586 - protein, 147 aa, Cebus apella
MSNFTAEDKAAITSLWAKVNVEDAGGETLGRLLVVYPWTQRFFDSFGSLSSPSAIMGNPKVKAHGAKVLTSLGEAIKNLDDLKGTFGQLSELHCDKLHVDPENFRLLGNVLVTVLAIHHGKEFTPEVQASWQKMVAGVASALGSRYH

SEQ ID NO: 1587 - protein, 147 aa, Cebus albifrons; identical to SEQ ID NO: 1586

SEQ ID NO: 1588 - protein, 185 aa, Meleagris gallopavo
VEVDCSRFPNTTNEEGKDVLVCTEDLRPICGTDGVTHSECLLCAYNIEYGTNISKEHDGECREAVPMDCSRYPNTTSEEGKVMILCNKALNPVCGTDGVTYDNECVLCAHNLEQGTSVGKKHDGECRKELAAVSVDCSEYPKPACTLEYRPLCGSDNKTYGNKCNFCNAVVESNGTLTLSHFGKC

SEQ ID NO: 1589 - protein, 20 aa, Meleagris gallopavo
VEVDCSRFPNTTNEEGKDVL

SEQ ID NO: 1590 - protein, 106 aa, Escherichia coli
MEKKHIYLFCSAGMSTSLLVSKMRAQAEKYEVPVIIEAFPETLAGEKGQNADVVLLGPQIAYMLPEIQRLLPNKPVEVIDSLLYGKVDGLGVLKAAVAAIKKAAAN

SEQ ID NO: 1591 - protein, 84 aa, Mus musculus
CPFTVTFYGALFREGDVWICMELMDTSLDKFYKQVIDKGQTIPEDILGKIAVSIVKALEHLHSKLSVIHRDVKPSNVLINTLGQ

SEQ ID NO: 1592 - protein, 97 aa, Mus musculus
KRLLMDLDVSMRTVDCPFTVTFYGALFREGDVWICMELMDTSLDKFYKQVIDKGQTIPEDILGKIAVSIVKALEHLHSKLSVIHRDVKPSNVLINTL

SEQ ID NO: 1593 - protein, 220 aa, Mus musculus
MAILFAVVARGTTILAKHAWCGGNFLEVTEQILAKIPSENNKLTYSHGNYLFHYICQDRIVYLCITDDDFERSRAFSFLNEVKKRFQTTYGSRAQTALPYAMNSEFSSVLAAQLKHHSENKSLDKVMETQAQVDELKGIMVRNIDLVAQRGERLELLIDKTENLVDSSVTFKTTSRNLARAMCMKNIKLTIIIIIVSIVFIYIIVSLLCGGFTWPNCVKK

SEQ ID NO: 1594 - protein, 586 aa, Mus musculus
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAIQEWVMNQAKVSVDGNKEDPQICVIELGGTIGDIEGMAFVEAFRQFQFKAKKENFYNIHVSLVPQPSATGEQKTKPTQNSVRALRGLGLSPDLIVCRSSTPIEMAVKEKISMFCHVNPEQVICIHDVSSIYRVPLLLEEQGVVKYFQERLGLPINDCSSNLLFKWKAMADRYERLQKICSIALVGKYTKLRDCYASVFKALEHSALAINHKLNLMYIDSIDLEPVTKAEDPVKFHEAWQKLCLADGILVPGGFGIRGTLGKLQAISWARTKKIPFLGICLGMQLAVIEFARNCLNLKDANSTEFEPNTPVPLVIDMPEHNPGDLGGTMRLGLRRTVFTTENSILKKLYGDVPYIEERHRHRYEVNPNLINQFENKDLCFVGEDVDGKRMEIVELTSHPYFIGVQFHPEFSSRPMKPSPPYLGLLLAATGNLNAHLQQMNKLPYSDGYSDASDDSFPEAKLAELDLN

SEQ ID NO: 1595 - protein, 521 aa, Mus musculus
MGSELLGKNSALFSSFPTFCGGGPLGCTVADGQTFMIASGYWQSPIRPPMKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAIQEWVMNQAKVSVDGNKEDPQICVIELGGTIGDIEGMAFVEAFRQFQFKAKKENFYNIHVSLVPQPSATGEQKTKPTQNSVRALRGLGLSPDLIVCRSSTPIEMAVKEKISMFCHVNPEQVICIHDVSSIYRVPLLLEEQGVVKYFQERLGLPINDCSSNLLFKWKAMADRYERLQKICSIALVGKYTKLRDCYASVFKALEHSALAINHKLNLMYIDSIDLEPVTKAEDPVKFHEAWQKLCLADGILVPGGFGIRGTLGKLQAISWARTKKIPFLGICLGMQLAVIEFARNCLNLKDANSTEFEPNTPVPLVIDMPEHNPGDLGGTMRLGLRRTVFTTENSILSLYLQCSG

SEQ ID NO: 1596 - protein, 452 aa, Rattus norvegicus
MEFQAVVMAVGGGSRMTDLTSSIPKPLLPVGNKPLIWYPLNLLERVGFEEVIVVTTKDVQKALCAEFKMKLKPDIVCIPDEADMGTADSLRHIYPKLKTDVLVLGCDLITDVALHEVVDLFRAYDASLAMLMRKGQESTEPVPGQKGKKKTVEQRDFIGVDSTGKRLLFMANEADLDEELVIKGSILQKHPRIHFQTGLVDAHLYCLKKYVVDFLMENKSITSIRSELIPYLVRKQFSSASSQQRQEDKEEDLKKKEPKSLDIYSFIKKDNTLTLAPYDACWNAFRRDKWEDLSRSQVRCYVHIMKEGLCSRVSTLGLYMEANRQVPKLLSVLCPEESMIHPSAQIANKHLIGADSLIGSDTQVGEKSSIKRSVIGSSCVIRDRVTVTNCLLMNSVTVEEGSSIHGSVICNNAVVEAGAEIRDCLIGSGQRIEAKAKRMNEVIVGNDQLMEI

SEQ ID NO: 1597 - protein, 185 aa, Rattus norvegicus; identical to SEQ ID NO: 1495

SEQ ID NO: 1598 - protein, 196 aa, Rattus norvegicus; identical to SEQ ID NO: 1496

SEQ ID NO: 1599 - protein, 197 aa, Rattus norvegicus
LVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRGVKMEQRKLSDQANTLVDLSKMQNVMYDLITELNDRSEDLEKQIGSLE

SEQ ID NO: 1600 - protein, 99 aa, Rattus norvegicus; identical to SEQ ID NO: 1500

SEQ ID NO: 1601 - protein, 69 aa, Rattus norvegicus
HDKQEVTSNFLGAMWLISITFLSIGYGDMVPHTYCGKGVCLLTGIMGAGCTALVVAVVARKLELTKAEK

SEQ ID NO: 1602 - protein, 85 aa, Rattus norvegicus
LISITFLSIGYGDMVPHTYCGKGVCLLTGIMGAGCTALVVAVVARKLELTKAEKHVHNFMMDTQLTKRVKNAAANVLRETWLIYK

SEQ ID NO: 1603 - protein, 591 aa, Mus musculus
MKYILVTGGVISGIGKGVIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQSRKMLMKWKEMADRYDRLLETCSIALVGKYTKFSDSYASVIKALEHSALAINHKLEIKYIDSTDLEPSTLQEEPVRYHEAWQKLCSAHGVLVPGGFGVRGTEGKIQAIAWARKQKKPFLGVCLGMQLAVVEFSRNVLGWQDANSTEFDPKTSHPVVIDMPEHNPGQMGGTMRLGKRRTLFQTKNSVMRKLYGDTDYLEERHRHRFEVNPVLKKCLEEQGLKFVGQDVEGERMEIVELEDHPFFVGVQYHPEFLSRPIKPSPPYFGLLLASVGRLPHYLQKGCRLSPRDTYSDRSGSSSPDSEITELKFPSISQD

SEQ ID NO: 1604 - protein, 130 aa, Mus musculus
ETLSRHCTTLGDALRKENDFALIIDGKTLKYALTFGVRQYFLDLALSCKAVICCRVSPLQKSEVVEMVKKQVKVITLAIGDGANDVSMIQTAHVGVGISGNEGLQAANSSDYSIAQFKYLKNLLMVHGAW

SEQ ID NO: 1605 - protein, 129 aa, Mus musculus
TLSRHCTTLGDALRKENDFALIIDGKTLKYALTFGVRQYFLDLALSCKAVICCRVSPLQKSEVVEMVKKQVKVITLAIGDGANDVSMIQTAHVGVGISGNEGLQAANSSDYSIAQFKYLKNLLMVHGAW

SEQ ID NO: 1606 - protein, 265 aa, Bacillus subtilis
MMDSMIIGKYVPGTSLVHRLDPRTKLITIFLFVCIVFLANNVQTYALLGLFTIGVVSLTRVPFSFLMKGLKPIIWIVLFTFLLHILMTHEGPIIFQIGFFKVYEGGLVQGIFISLRFVYLILITTLLTLTTTPIEITDGMEQLLNPLKKLKLPVHELALMMSISLRFIPTLMEETDKIMKAQMARGVDFTSGPVKERVKAIVPLLVPLFVSAFKRAEELAVAMEARGYQGGEGRTKYRKLVWTGKDTSVIVSLIVLAALLFFLRA

SEQ ID NO: 1607 - protein, 511 aa, Haemophilus influenzae
MSNLKQHKQALFCNDNEAINDYETAMHNAVQAVSAWLKNEKMYTGGSIKQMRALISGFNPTKEGMGVQKSLDHLVEIFLNPSLKVHHPHSLAHLHCPTMVTSQIAEVLINATNQSMDSWDQSPAGSIMEEHLINWLRQKAGYGEGTSGVFTSGGTQSNLMGVLLARDWAIANHWKNEDGSEWSVQRDGIPAEAMQKVKVICSENAHFSVQKNMAMMGMGFQSVVTVPSNANAQMDLIALKQTLAQLKADGKITACIVATAGTTDAGAIDDLKAIRKLADEYQAWLHVDAAWGGALLLSKDYRYFLDGIELTDSITLDFHKHFFQTISCGAFLLKDPENYRFIDYKADYLNSEYDEAHGVPNLVAKSLQTTRRFDALKLWFTLEALGEDLYASMIDHGVKLTKEVEQYINDTPDLEMLVPSQFASVLFRVVPKDYPAEFIDALNQNVADELFARGEANIGVTKVGDKQSLKMTTLSPIATLENVKALLTQVLTEANRIKDDIKNGTYTPPID

SEQ ID NO: 1608 - protein, 245 aa, Haemophilus influenzae
MKKLVAVTSMILTTFSVQAADLYLYAGAGLKEPVEKIIHQYEQETGNKVTVEYGGSGQILARYNTVKSGDLFLAGSEDYVTKLQKTNDVNNIGTIVLHVPVMAIRKDKISGIDSFKALAESSLRLGIGDSKAMALGKGAEKMFELSGYQKQLNDKIVVKAATVKQLMLYLLNGDVDAAVVGRSGAWKVRDKVELLPSPKGTPEEKVTIGLLFSSKYPKEAQQLFDFFKSPQGVKYFTDEGFLPAK

SEQ ID NO: 1609 - protein, 147 aa, Staphylococcus aureus
MVVKQQKDASKPAHFFHQVIVIALVLFVSKIIESFMPIPMPASVIGLVLLFVLLCTGAVKLGEVEKVGTTLTNNIGLLFVPAGISVVNSLGVISQAPFLIIGLIIVSTILLLICTGYVTQIIMKVTSRSKGDKVTKKIKIEEAQAHD

SEQ ID NO: 1610 - protein, 421 aa, Mycoplasma pneumoniae
MNIVNLISKKQRGKALTETEINWFVHSVNNKSLADYQVSAFLMAVWFQGMNSKELFCLTKAMVKSGESLHFNHHSKLSVDKHSTGGIGDKVSIALIPILTALDYSVAKLSGRGLGYTGGTIDKLEAVGVKTDFTPTEAQNLLDQNDCFIIGQSEGIAPVDKVLYALRDTTATVDSLPLIASSVMSKKLAINNDYIFIDLKYGKGAFCKTKTMAKELAQYMYSIAKQFKRKLYIKLSDMNQVLGKTIGNALEVLEVVHFLKRNWTEVGADFIQLMEQIVTEILIETKRAPNKRAAVALYHATLEGEKPWQRFLKFIELQGSSWERFLDLKELFNPQYKAPVLASQSGTLSYTSPVDLAMVSISLGAGRMVKTDLIDPMAGIKLVKQANEVVKAGDTVLELYSSKPITPAHIEAAQHTIIIKQ

SEQ ID NO: 1611 - protein, 130 aa, Mycoplasma pneumoniae
QVSAFLMAVWFQGMNSKELFCLTKAMVKSGESLHFNHHSKLSVDKHSTGGIGDKVSIALIPILTALDYSVAKLSGRGLGYTGGTIDKLEAVGVKTDFTPTEAQNLLDQNDCFIIGQSEGIAPVDKVLYAL

SEQ ID NO: 1612 - protein, 92 aa, Mycoplasma pneumoniae
VSAFLMAVWFQGMNSKELFCLTKAMVKSGESLHFNHHSKLSVDKHSTGGIGDKVSIALIPILTALDYSVAKLSGRGLGYTGGTIDKLEAVGV

SEQ ID NO: 1613 - protein, 271 aa, Mycoplasma pneumoniae
MDTFTSAVKINWFPGHMKKTHDQLKKLASSLDGVIEVVDARAPTLTQNPEITAYFTNKPKLTLALKADLAQTVANSNILWGTLKQGLQLKRLVIKKLQTLFQAKKNQLKAKGLLVHQFRLAVIGMPNVGKSSLINLLLNKNHLQVANRAGVTKSMSWNQISSEFYLSDTPGVFFKRIDEMAVGYKLVLTNVIKREVVPLEDVGAFAFCYLSKHYPQLLPYEGTDFTEFLHKFAISRKLLQKSNQLNINLACELFVSELINGKYGKLSFELD

SEQ ID NO: 1614 - protein, 572 aa, Mycoplasma pneumoniae
MKKLSGIGVSDGMALAKAFLVKTPEFAVNKYLKHQLTKAQAKRLLDSAFKKAVKDLEEIKEITVNNINTEAGMIFDAHIQMLNDPTITEQLEQQLAQNVHPVIAVDTVFSQTATMFSQMQDKYFQERAADILDLRQRLLAYLTGQKPHDLVKIKSDVIIVAHDLTPSQTATLNKKYVKGFLTEIGGRTSHAAIMARSLEIPAVVGIKGITTKVKDGQIVGVDGRKGIAGLDLNSKDTTEWKKQKALEEKYQQELKQYTNKETVTLDGHAVVVAANIGNVKDMELACQYNTNGVGLFRTEFLYMNSQEWPDEETQYQAYKAVLEQAHGDLVIIRTLDIGGDKKLNYYEFPHEDNPFLGYRALRLTLDKQDIFKTQLRALLRAADHGQLGIMFPMVATLDELLQAKQLLNQVHQELGGNKQFKLGIMIEIPAAVLAANTLSHHVDFFSIGTNDLIQYSFAADRMNKNVSYLYQPLNPALLKLIYLTIEGGKVNDIWTGMCGEMAGEPLAIPLLLGLGLKEFSMSASSMFKARMIIAKLNYTECQTLAQKALTLANAKEVEKLVEKFFKKKDIFI

SEQ ID NO: 1615 - protein, 387 aa, Mycoplasma pneumoniae
MGLHNEPNTILICRYGELVLKGKNRLQFVKQLKKNVKQAFKKLSITNPVDYQFDMLVVGEVISTQRSLLKNLFTRLPGLSVCLFALQIPHDEAQLLALLQQVVQSHPSFKIEVRRRDKLFACNSSAFKKYLALQLWEKYQLKGKLVDPAITVHVEVTKEHFLIISESFNGIGGLPVFTSGTALALLSGGIDSPVAASLVLQRGFNVDFITFINEPGHNAATIGKIQRLANLVSLNQTLCTGRLFVFDFTDLQKELSHISLEGYRIVLMRRCFYKIASLFKYDCLITGEALGQVASQTIDNLKVIQAVVPNTFVIRPLIGLSKDKIIEWAKALGTFETSIEHHMDTCTVFAPKKPTTKAKLAIVEKLESELLFVRELIEAGVKKLQND

SEQ ID NO: 1616 - protein, 216 aa, Mycoplasma pneumoniae
MDPPNVGRDVKRMVAIAEQLKGKLNIIMATGFHKAAFYDKGSSWLAQVPVNEIVPMLVAEIEEGMDLYNYSGPVVKRGKAKAGIIKAGTGYAAIDRLELKALEAVAITSITTGAPVLVHTQLGTMAYEAAQHLIDFGVNPRKIQLSHLNKNPDEYYYAKIIRELGVTLCFDGPDRVKYYPDCLLAKHIKYLVDLGFVKHITLALDAGRVLYQNTMV

SEQ ID NO: 1617 - protein, 219 aa, Escherichia coli
MYQHHNWQGALLDYPVSKVVCVGSNYAKHIKEMGSAVPEEPVLFIKPETALCDLRQPLAIPSDFGSVHHEVELAVLIGATLRQATEEHVRKAIAGYGVALDLTLRDVQGKMKKAGQPWEKAKAFDNSCPLSGFIPAAEFTGDPQNTTLSLSVNGEQRQQGTTADMIHKIVPLIAYMSKFFTLKAGDVVLTGTPDGVGPLQSGDELTVTFDGHSLTTRVL

SEQ ID NO: 1618 - protein, 248 aa, Escherichia coli
MLKKILLLALLPAIAFAEELPAPVKAIEKQGITIIKTFDAPGGMKGYLGKYQDMGVTIYLTPDGKHAISGYMYNEKGENLSNTLIEKEIYAPAGREMWQRMEQSHWLLDGKKDAPVIVYVFADPFCPYCKQFWQQARPWVDSGKVQLRTLLVGVIKPESPATAAAILASKDPAKTWQQYEASGGKLKLNVPANVSTEQMKVLSDNEKLMDDLGANVTPAIYYMSKENTLQQAVGLPDQKTLNIIMGNK

SEQ ID NO: 1619 - protein, 433 aa, Geobacillus stearothermophilus
MRMVDLIEKKRDGHALTKEEIQFIIEGYTKGDIPDYQMSALAMAIFFRGMNEEETAELTMAMVHSGDTIDLSRIEGIKVDKHSTGGVGDTTTLVLGPLVASVGVPVAKMSGRGLGHTGGTIDKLESVPGFHVEITNDEFIDLVNKNKIAVVGQSGNLTPADKKLYALRDVTATVNSIPLIASSIMSKKIAAGADAIVLDVKTGVGAFMKDLNDAKALAKAMVDIGNRVGRKTMAIISDMSQPLGYAIGNALEVKEAIDTLKGEGPEDFQELCLVLGSHMVYLAEKASSLEEARHMLEKAMKDGSALQTFKTFLAAQGGDASVVDDPSKLPQAKYIIELEAKEDGYVSEIVADAVGTAAMWLGAGRATKESTIDLAVGLVLRKKVGDAVKKGESLVTIYSNREQVDDVKQKLYENIRISATPVQAPTLIYDKIS

SEQ ID NO: 1620 - protein, 336 aa, Mycoplasma pneumoniae
MVQKEMINKKISQDNSFIQNNNLADFDFLDAKKNSEIKTVSTGSLHLDEALGTGGLPLGRIVELYGNESSGKTTVALHAVASFQKAGKVACYIDAEGALDLSYAKAIGIDLGKLLVAHPKHGENAFALMESLIKTNKVALIVVDSVAALIPKQELEGNMDDQTIGLHARMMSKGLRRVQSLLPESDTCLLFINQLREKPGVMFGNGEVTTGGRALKFYASMRMEAKRSELLKDRFGNYVGIKSKLTVSKNKVARPFGVAFLEIMFNRGIVYEHEVIELALKHNVVVRSDNAYSFKSQNIAIGKEKLFSVLAEKPELFEQIKQLTIKQIHSPPPPAS

SEQ ID NO: 1621 - protein, 409 aa, Mycoplasma pneumoniae
MVDFKTVQAFDFQGKTVVLRADLNVPMKDGVITDNERILASLDTIKYLLGHNCKIVLLSHLSRVKSLDDKKGKKSLQPVASALQNLLKNTKVHFCPENTGDKVKVAVNQLPLGEILVLENTRYCDVNEAGEVVKHESKNNAELAQFWASLGDIFVNDAFGTAHRRHASNAGIAKYIKNSCIGLLMERELINLYRLINNPPKPFVVVLGGAKVSDKLQVVNNLFKIADHILIGGGMVNTFLKALGNEVGTSLVEEDLVQTAKQILDSDKDKKIVLGVDQMLHASFKDEPGVECVVAPQWPAELQGFMSLDVGSKTVALFSSYLAKAKTIFWNGPMGVFEFSNYAQGTLAIGKAIAQNQQAFSVIGGGDSAAAAKQLQIADQFSFISTGGGASLALIGGEELVGISDIQKK

SEQ ID NO: 1622 - protein, 384 aa, Bos taurus
MKMGPLGAEADENQTVEEMKVDQFGPGHTTLPGELAPDSEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKQISFLIIGLAWGVSALLASPLAIFREYSLIEIIPDFEIVACTEKWPGEEKGIYGTIYSLSSLLILYVLPLGIISFSYTRIWSKLKNHVSPGAAHDHYHQRRQKTTKMLVCVVVVFAVSWLPLHAFQLAVDIDSHVLDLKEYKLIFTVFHIIAMCSTFANPLLYGWMNSNYRKAFLSAFRCEQRLDAIHSEVSVTFKAKKHLQVTKNNGPNDSFTETTNV

SEQ ID NO: 1623 - protein, 175 aa, Bos taurus
EIVACTEKWPGEEKGIYGTIYSLSSLLILYVLPLGIISFSYTRIWSKLKNHVSPGAAHDHYHQRRQKTTKMLVCVVVVFAVSWLPLHAFQLAVDIDSHVLDLKEYKLIFTVFHIIAMCSTFANPLLYGWMNSNYRKAFLSAFRCEQRLDAIHSEVSVTFKAKKHLQVTKNNGPND

SEQ ID NO: 1624 - protein, 51 aa, Bos taurus
KTTKMLVCVVVVFAVSWLPLHAFQLAVDIDSHVLDLKEYKLIFTVFHIIAM

SEQ ID NO: 1625 - protein, 67 aa, Oryctolagus cuniculus
LVTKMRETLEAESHMYLKAVKATMILVPLLGIQFVVFPWRPSNKILGKIYDYLMHSLIHFQVQTTVK

SEQ ID NO: 1626 - protein, 42 aa, Oryctolagus cuniculus
ETLEAESHMYLKAVKATMILVPLLGIQFVVFPWRPSNKILGK

SEQ ID NO: 1627 - protein, 124 aa, Ovis aries
KKTQTWIITCIYLQLLLFNPLVHTQGICRNRVTDDVKDVTKLVANLPKDYMITLKYVPGMDVLPSHCWISEMVEQLSVSLTDLLDKFSNISEGLSNYSIIDKLVKIVDDLVECMEEHSFENVKK

SEQ ID NO: 1628 - protein, 66 aa, Ovis aries
KKTQTWIITCIYLQLLLFNPLVHTQGICRNRVTDDVKDVTKLVANLPKDYMITLKYVPGMDVLPSH

SEQ ID NO: 1629 - protein, 503 aa, Sus scrofa
MVLEMLNPMYYKITSMVSEVVPFASIAVLLLTGFLLLLWNYENTSSIPSPGYFLGIGPLISHFRFLWMGIGSACNYYNEMYGEFMRVWIGGEETLIISKSSSVFHVMKHSHYTSRFGSKPGLECIGMYEKGIIFNNDPALWKAVRTYFMKALSGPGLVRMVTVCADSITKHLDKLEEVRNDLGYVDVLTLMRRIMLDTSNNLFLGIPLDEKAIVCKIQGYFDAWQALLLKPEFFFKFSWLYKKHKESVKDLKENMEILIEKKRCSIITAEKLEDCMDFATELILAEKRGELTKENVNQCILEMLIAAPDTLSVTVFFMLFLIAKHPQVEEAIVKEIQTVIGERDIRNDDMQKLKVVENFIYESMRYQPVVDLVMRKALEDDVIDGYPVKKGTNIILNIGRMHRLEFFPKPNEFTLENFAKNVPYRYFQPFGFGPRACAGKYIAMVMMKVTLVILLRRFQVQTPQDRCVEKMQKKNDLSLHPDETSGLLEMIFIPRNSDKSLDH

SEQ ID NO: 1630 - protein, 106 aa, Carassius auratus
TGRFASKKGLQCIGMFEQGIIFNSNMALWKKVRTYFTKALTGPGLQKSVDVCVSATNKQLNVLQEFTDHSGHVDVLNLLRCIVVDVSNRLFLRIPLNEKDLLIKIH

SEQ ID NO: 1631 - protein, 200 aa, Carassius auratus
TGRFASKKGLQCIGMFEQGIIFNSNMALWKKVRTYFTKALTGPGLQKSVDVCVSATNKQLNVLQEFTDHSGHVDVLNLLRCIVVDVSNRLFLRIPLNEKDLLIKIHRYFSTWQAVLIQPDVFFRLNFVYKKYHLAAKELQDEMGKLVEQKRQAINNMEKLDETDFATELIFAQNHDELSVDDVRQCVLEMVIAAPDTLSI

SEQ ID NO: 1632 - protein, 182 aa, Danio rerio
GLYTLMVTFLCTIVLPVLLFLAAVKLWEMLMIRRVDPNCRSPLPPGTMGLPFIGETLQLILQRRKFLRMKRQKYGCIYKTHLFGNPTVRVMGADNVRQILLGEHKLVSVQWPASVRTILGSDTLSNVHGVQHKNKKKAIMRAFSRDALEHYIPVIQQEVKSAIQEWLQKDSCVLVYPEMKKL

SEQ ID NO: 1633 - protein, 32 aa, Danio rerio
CVGKEFAKVLLKIFLVELTQHCNWILSNGPPT

SEQ ID NO: 1634 - protein, 332 aa, Sceloporus woodi
MSLKEKLIVNVHKEEQPHAHNKITVVGVGAVGMACAISILMKDLADELALVDVIEDKLKGEMLDLQHGSLFLRTPKIVSGKDYAVTAHSKLVIITAGARQQEGESRLNLVQRNVNIFKFIIPNVVKYSPDCKLLVVSNPVDILTYVAWKISGFPKHRVIGSGCNLDSARFRHLMAEKLGIHPLSCHGWIVGEHGDSSVPVWSGVNVAGVSLKGLHPDMGTDGDKENWKQVHKQVVDSAYEVIKLKGYTSWAIGLSVADLAETIMKNLRRVHPVSTMVKGMHGINDDVFLSVPCVLGYSGITDVVKMTLKSEEEDKLRKSADTLWGIQKELQF

SEQ ID NO: 1635 - protein, 41 aa, Xenopus laevis
VTMHFQNLKKEEQKKKRLLKIIITLVVVFAICWLPFHILKT

SEQ ID NO: 1636 - protein, 61 aa, Xenopus laevis
KKKRLLKIIITLVVVFAICWLPFHILKTIHFLDLMGFLELSCSTQNIIVSLHPYATCLAYV

SEQ ID NO: 1637 - protein, 142 aa, Trematomus bernacchii
SLSDKDKAAVRALWSKIGKSADAIGNDALSRMIVVYPQTKTYFSHWPDVTPGSPHIKAHGKKVMGGIALAVSKIDDLKTGLMELSEQHAYKLRVDPANFKILNHCILVVISTMFPKEFTPEAHVSLDKFLSGVALALAERYR

SEQ ID NO: 1638 - protein, 142 aa, Chelidonichthys kumu
SLSDKDKNTVRALWAKISKSADVIGAEALARMLTVYPQTKTYFTHWTDLSPSSTSVKNHGKNIMVGVSLAVSKMDDLTAGLLELSEKHAFQLRVDPANFKLLSHCLLVVISIMFPKEFGPEVHVSVDKFFANLALALSERYR

SEQ ID NO: 1639 - protein, 316 aa, Sus scrofa
MASHLVLYTGAKMPILGLGTWKSPPGKVTEAVKVAIDLGYRHIDCAHVYQNENEVGLGLQEKLQGQVVKREDLFIVSKLWCTDHEKNLVKGACQTTLRDLKLDYLDLYLIHWPTGFKPGKDPFPLDGDGNVVPDESDFVETWEAMEELVDEGLVKAIGVSNFNHLQVEKILNKPGLKYKPAVNQIEVHPYLTQEKLIEYCKSKGIVVTAYSPLGSPDRPWAKPEDPSLLEDPRIKAIAAKYNKTTAQVLIRFPMQRNLIVIPKSVTPERIAENFQVFDFELSPEDMNTLLSYNRNWRVCALMSCASHKDYPFHEEY

SEQ ID NO: 1640 - protein, 531 aa, Mus musculus
MAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQFLEQVKVSKEMDRETLIDVARTSLRTKVHAELADVLTEAVVDSILAIRKKDEPIDLFMVEIMEMKHKSETDTSLIRGLVLDHGARHPDMKKRVENAYILTCNVSLEYEKTEVNSGFFYKSAEEREKLVKAERKFIEDRVKKIIELKKKVCGDSDKGFVVINQKGIDPFSLDALAKEGIVALRRAKRRNMERLTLACGGIALNSFDDLNPDCLGHAGLVYEYTLGEEKFTFIEKCNNPRSVTLLVKGPNKHTLTQIKDAIRDGLRAVKNAIDDGCVVPGAGAVEVALAEALIKYKPSVKGRAQLGVQAFADALLIIPKVLAQNSGFDLQETLVKVQAEHSESGQLVGVDLSTGEPMVAAEMGVWDNYCVKKQLLHSCTVIATNILLVDEIMRAGMSSLKG

SEQ ID NO: 1641 - protein, 392 aa, Bacillus subtilis
MSKHIVILGAGYGGVLSALTVRKHYTKEQARVTVVNKYPTHQIITELHRLAAGNVSEKAVAMPLEKLFKGKDIDLKIAEVSSFSVDKKEVALADGSTLTYDALVVGLGSVTAYFGIPGLEENSMVLKSAADANKVFQHVEDRVREYSKTKNEADATILIGGGGLTGVELVGELADIMPNLAKKYGVDHKEIKLKLVEAGPKILPVLPDDLIERATASLEKRGVEFLTGLPVTNVEGNVIDLKDGSKVVANTFVWTGGVQGNPLVGESGLEVNRGRATVNDFLQSTSHEDVFVAGDSAVYFGPDGRPYPPTAQIAWQMGELIGYNLFAYLEGKTLETFKPVNSGTLASLGRKDAVAIIGANSTPLKGLPASLMKEASNVRYLTHIKGLFSLAY

SEQ ID NO: 1642 - protein, 142 aa, Meleagris gallopavo
MVLSAADKNNVKGIFTKIAGHAEEYGAETLERMFITYPPTKTYFPHFDLSHGSAQIKGHGKKVVAALIEAANHIDDIAGTLSKLSDLHAHKLRVDPVNFKLLGQCFLVVVAIHHPAALTPEVHASLDKFLCAVGTVLTAKYR

SEQ ID NO: 1643 - protein, 202 aa, Bacillus subtilis
MTNTLDVLKARASVKEYDTNAPISKEELTELLDLATKAPSAWNLQHWHFTVFHSDESKAELLPVAYNQKQIVESSAVVAILGDLKANENGEEVYAELASQGYITDEIKQTLLGQINGAYQSEQFARDSAFLNASLAAMQLMIAAKAKGYDTCAIGGFNKEQFQKQFDISERYVPVMLISIGKAVKPAHQSNRLPLSKVSTWL

SEQ ID NO: 1644 - protein, 288 aa, Sus scrofa
MEKIPVLGLGTWQAAPGEVTEAVKVAIDTGYRHFDCAYLYHNENEVGVGIQAKIDEGVVRREDLFIVSKLWCTCHKKSLVKSACTRSLKALKLQYLDLYLIHWPMGFKPGEVDLPVDRSGMIVASNTDFLDTWEAMEDLVIEGLVRAIGVSNFNHEQLERLLNKPNLRVKPVTNQIECHPYLTQKKLISFCQSRNVSVTAYRPLGGSSEGVPLLEDPVIQTIAQKHGKSAAQILIRFQIQRNVIVIPKSVNPKRILENFQVFDFELSEQDMTDLLGLDRNLRLSAFPM

SEQ ID NO: 1645 - protein, 188 aa, Arabidopsis thaliana
MDKLNFFEEIRKDAEETYKLNPEDADNLMRWGEALLELSQFQNVIDSLKMIQDAISKLEDAILIDPMKHDAVWCLGNAYTSYARLTPDDTQARLNFGLAYLFFGIAVAQQPDNQVYHKSLEMADKAPQLHTGFHKNRLLSLLGGVETLAIPSPKVVKNKKSSDEKYIVMGWVILAIGVVACISFRKLR

SEQ ID NO: 1646 - protein, 142 aa, Pagothenia borchgrevinki
SLSEKNKAAVKALWSKIGKSSDAIGNDALSRMIVVYPQTKTYFSHWPEVTPGSPHIKAHGKKVMGGIALAVTKIDDLKTGLSELSEQHAYKLRVDPANFKTLNHCILVVISTMFPKEFTPEAHVSLDKFLSGVALALADRYR

SEQ ID NO: 1647 - protein, 147 aa, Geochelone nigra
MVHWTPEEKQYITSLWAKVNVEEVGGEALARLLIVYPWTQRFFSSFGNLSSASAILHNAKVLAHGKKVLTSFGDAVKNLDNIKKTFAQLSELHCEKLHVDPENFKLLGNILIIVLATRFPKEFTPASQAAWTKLVNAVAHALALGYH

SEQ ID NO: 1648 - protein, 143 aa, Anarhichas minor
MSLTAKDKDTVRAFWAKASGKAAEIGSDALSRMLVVYPQTKTYFSHWKDLSPGSEPVKKHGKSVMGGVADAVMKIEDLNAGLLNLSELHAFTLRVDPANFKILSHNILVVMAIMFPKDFTPEVHVAMDKFLAALSRALAEKYR

SEQ ID NO: 1649 - protein, 143 aa, Anarhichas minor
MSLTEKDKAAVIAMWGKIHKSADAIGADALGRMLVVYPQTKTYFSHWSDLSPNSAPVKTHGKNVMSGVALAVSKIDDMTKGLMALSEQHAFQLRVDPANFKILSHCILVVIASMFPKDFTPEAHVSMDKFFCGLSLALAEKYR

SEQ ID NO: 1650 - protein, 146 aa, Anarhichas minor
VKWSDKERAVIISIFAGLDYEDIGPKALSRCLIVYPWTQRYFGSFGNLSTPAAIMGNPKIAAHGIKVLHGLDRGVKNMDNIKDAYTELSILHSETLHVDPDNFKLLADCLTIVVAAKMGCAFTPDTQLAFQKFLAVVVSALGKQYC

SEQ ID NO: 1651 - protein, 143 aa, Conger conger
MSLTAKDKTLVKTFWGKVKGKADAMGAEALGRMLVVYPQTKTYFAHWSDQSPGSEPVKHGKKTIMGAVGDAVGKIDNLLGGLSALSEVHATKLAIDPGNFKLLSHCLLVTFAVNYPTDFTAEVHVAVDKFLAAVSAALADKYR

SEQ ID NO: 1652 - protein, 142 aa, Pseudaphritis urvillii
SLTDKDKATVKALWGKISKSADAVGADAVGRMIVVYPQTKTYFSHWPDLAPNSPHVKTHGKTVMTGIALAVSKIDDLTNGLLELSEEHAYKMRVDPANFKILSHCMLVVIATMFPKEFTPEAHVCLDKFLCAVSLALSERYR

SEQ ID NO: 1653 - protein, 146 aa, Pseudaphritis urvillii
VVWTNEERSIISSIFSNLDYDDIGPKALCRCLIVYPWTQRHFTTFGNLYTPEAIMTNSKVAEHGVKVLHGLDRAVKNMDNIKATYYDLSILHSEKLHVDPDNFKLLSDCLTIVVAAKMGSGFTPETQAAFQKFLAVVVSALGKQYH

SEQ ID NO: 1654 - protein, 134 aa, Pseudaphritis urvillii
ISSIFSNLDYDDIGPKALCRCLIVYPWTQRHFTTFGNLYTPEAIMTNSKVAEHGVKVLHGLDRAVKNMDNIKATYYDLSILHSEKLHVDPDNFKLLSDCLTIVVAAKMGSGFTPETQAAFQKFLAVVVSALGKQ

SEQ ID NO: 1655 - protein, 35 aa, Mus musculus
AEMLKGLQHPNIVRFYDSWESTVKGKKCIVLVTEL

SEQ ID NO: 1656 - protein, 63 aa, Mus musculus
HPNIVRFYDSWESTVKGKKCIVLVTELMTSGTLKTYLKRFKVMKIKVLRSWCRQILKGLQFLH

SEQ ID NO: 1657 - protein, 35 aa, Mus musculus; identical to SEQ ID NO: 1655

SEQ ID NO: 1658 - protein, 63 aa, Mus musculus; identical to SEQ ID NO: 1656

SEQ ID NO: 1659 - protein, 35 aa, Mus musculus; identical to SEQ ID NO: 1655

SEQ ID NO: 1660 - protein, 63 aa, Mus musculus; identical to SEQ ID NO: 1656

SEQ ID NO: 1661 - protein, 35 aa, Mus musculus; identical to SEQ ID NO: 1655

SEQ ID NO: 1662 - protein, 63 aa, Mus musculus; identical to SEQ ID NO: 1656

SEQ ID NO: 1663 - protein, 337 aa, Candida albicans
MVKVAILGAAGGIGQPLSLLTKLNPNVDELALFDVVNVPGVGADLSHINSDSKTQSYLPKDKEDKTALAAALKGSDLVIIPAGVPRKPGMTRDDLFNINASIVQGLAEGIAANSPKAFVLVISNPVNSTVPIVAETLQAKGVYDPARLFGVTTLDIVRANTFISQLFLDQTKPSDFNINVVGGHSGETIVPLYSLGNSKQYYDILSEEQKKELIKRVQFGGDEVVQAKNGAGSATLSMAYAGYRLAESILAAVNGKTDIVECTFLNLDSSIKGASEARKLVKDLDFFSLPVQLGKNGITEVKYDILNQISDDEKKLLEVAIEQLQKNIEKGVSFAKK

SEQ ID NO: 1664 - protein, 450 aa, Candida albicans
MSSAPATNYKVADISLAAFGRKDIELSENEMPGLMYIRKKYGPSQPLKGARIAGCLHMTIQTAVLIETLVALGAEVTWSSCNIFSTQDHAAAAIAAAGVPVFAWKGETEEEYQWCIEQQLFAFKDGKKLNLILDDGGDLTSLVHEKYPEMLEDCYGLSEETTTGVHHLYKSLRDGKLKVPAINVNDSVTKSKFDNLYGCRESLVDGIKRATDVMIAGKVAIVAGFGDVGKGCAMALHGMGARVIVTEIDPINALQAAVSGYQVAPMDEVASIGQIFVTTTGCRDIITGKHFEQMPEDAIVCNIGHFDIEIDVAWLKANAESVVNIKPQVDRYLMKNGRHVILLADGRLVNLGCATGHSSFVMSCSFSNQVLAQIALFNADNKEFREKFPEFAKTGPFDVGVHLLPKVLDETVARCHLDHLGAKLTTLTETQAEYLGIPEEGPYKADIYRY

SEQ ID NO: 1665 - protein, 433 aa, Rattus norvegicus
MQALNITAEQFSRLLSAHNLTREQFIHRYGLRPLVYTPELPARAKVAFALAGALIFALALFGNSLVIYVVTRSKAMRTVTNIFICSLALSDLLIAFFCIPVTMLQNISDKWLGGAFICKMVPFVQSTAVVTEILTMTCIAVERHQGLVHPFKMKWQYTTRRAFTILGVVWLAAIIVGSPMWHVQRLEIKYDFLYEKEHICCLEEWASPVHQRIYSTFILVILFLLPLVVMLVLYSKIGYELWIKKRVGDSSALQTIHGKEMSKIARKKKRAVIMMVTVVALFAACWAPFHVVHMMVEYSNFEKEYDDVTIKMVFAVAQTIGFFNSICNPFVYAFMNENFKKNFLSAVCYCIVKESSSPARKPGNSGISMMQKRAKLSRPQRPVEETKGDTFSDASIDVKLCEQPREKRQLKRQLAFFSSELSENSTFGSGHEL

SEQ ID NO: 1666 - protein, 83 aa, Mus musculus
LEEWASPMHQRIYTTFILVILFLLPLVVMLVLYSKIGYELWIKKRVGDSSALQTIHGKEMSKIARKKKRAVVMMVTVVALFAA

SEQ ID NO: 1667 - protein, 68 aa, Mus musculus
HQRIYTTFILVILFLLPLVVMLVLYSKIGYELWIKKRVGDSSALQTIHGKEMSKIARKKKRAVVMMVT

SEQ ID NO: 1668 - protein, 143 aa, Cottoperca gobio
MSLTEKDKAAVRALWGKISKSADAIGADALSRMLFVYPQTKTYFTHWPDLSPGSVHVKKHGKNVMGGIALAVSKIDDLTNGLMELSEQHAYQLRVDPANFKILSHCILVVVSIMYPKDFTPEAHVSLDKFLSGVSLALAERYR

SEQ ID NO: 1669 - protein, 147 aa, Aythya fuligula
MVHWTAEEKQIITGLWGKVNVADCGAEALARLLIVYPWTQRFFSSFGNLSSPTAILGNPMVRAHGKKVLTSFGDAVKNLDNIKNTFAQLSELHCDKLHVDPENFRLLGDILIVVLAAHFSKEFTPECQAAWQKLVRVVAHALARKYH

SEQ ID NO: 1670 - protein, 143 aa, Liparis tunicatus
MSLSTKDKETVKDLWGHISASADAIGADALGRLLVVYPQTKIYFLHWPDLSPNSPSVKNHGKNIMSGIALAVTKIDDLKSGLNALSEQHAFQLRVDPANFKLLSHCILVVLAIRFPHEFTPEAHVAMDKFFCGVSLALAEKYR

SEQ ID NO: 1671 - protein, 143 aa, Cottoperca gobio
MSLSTKDKDTVTAFWGKVSCKAGDIGTDALSRMLVVYPQTKTYFSHWKELGPGSPPVQKHGMTVMKGVGEAVAKIDDLTAGLLNLSELHAFTLRVDPANFKILSHNILVVFAIMFPHDFTPEVHVSMDKFLAALARALSEKYR

SEQ ID NO: 1672 - protein, 147 aa, Mus musculus
AKLTHLFDNEGTVLFAIFMALWATVFLEIWKRKRAHEVQSWKLYEWDEEEEEMALELINSPHYKLKDHRHSYLSSTIILILSLFMICLMIGMAHVLVVYRVLAGALFSSLVKQQVTTAVVVTGAVVHYIIIVIMTKVNKYVALKLCK

SEQ ID NO: 1673 - protein, 123 aa, Mus musculus
KLYEWDEEEEEMALELINSPHYKLKDHRHSYLSSTIILILSLFMICLMIGMAHVLVVYRVLAGALFSSLVKQQVTTAVVVTGAVVHYIIIVIMTKVNKYVALKLCKFEESGTFSEQERKFTVK

SEQ ID NO: 1674 - protein, 146 aa, Iguana iguana
VHWTAEEKQLITCLWGKVDVPTVGADALAGMLVMYPWTQRFFADFGNLSSATAICGNPKVRAHGKKVLTAFGDAIKNLDNIKDTFAKLSELHCDKLHVDPENFKLLGNVLIIVLAGHYGKDFTPACHAAYQKLVNVVAHALARRYH

SEQ ID NO: 1675 - protein, 146 aa, Amblyrhynchus cristatus
VHWTAEEKQLITCLWGKVDVATIGGESLAGMFVMYPWTQRLFSEFGNLSSPTAICGNPKVKAHGKKVLTAFGDAIRNLDNIKDTFAKLSELHCDKLHVDPENFKLLGKVLLIVLAGHYGKDFTPACHAAYQKLVNVVAHALARRYH

SEQ ID NO: 1676 - protein, 181 aa, Mytilus galloprovincialis
MISKYCLFVIVLGTTGTALVLTNDSNKLQNVKAVIAIQDKVLHFHDHTTDCVGELMCIFAALPESERNQTLSIPLGLLTTIATDKGRDRYSSIYAEAKKLLAGYPTIKHALNAAENGHSTKDKNVCASMYSKCPFEPDDLLDTINDLEDITTLFSKNVFGKVIADAIEYNYTQVGMTQTHS

SEQ ID NO: 1677 - protein, 374 aa, Mesocricetus auratus
STAGKVIKCKAAVLWETNKPFSIEEIEVAPPKAHEVRIKMVATGICRTDDHAATGNFVTPLPIVLGHEGAGIVESVGEGVTSVKPGDKVIPLFSPQCGKCRVCKHPESNLCIKNDLAAPRGTLLDGTCRFTCKGKSIHNFLSTSTYSQYTVVDEMAVAKIDEASPLEKVCLIGCGFTTGYGSAVQFAKVTPGSSCAVFGLGGVGLSVIIGCKTAGAARIIGVDTNKDKFAKAKELGATECINPLDYNKPIAEVLQEMTDGGVDFSFEVVGQLDTMMSALDSCHAACGVSVIIGVPPNAQNLSVNPMLLLGGRTWKGAIFGGYKSKDAVPKLVADFMAKKFPLEPLITHVLPFEKINEGFDLLRSGKSIRTVLTF

SEQ ID NO: 1678 - protein, 405 aa, Schizosaccharomyces pombe
MQIPEKYLSSVDNVEEETQILFALSKQKDADLGMLDSKQEQIALTIGNKPIKVKQSLQSLHQSRGSTGSVLWKTSVKVVPWLLQQSWFMNSLTPKTSILELGSGISGLAGILLSPFVGNYVASDKQLYLKKIRENLDQNNASDVEVHELDWKSTPYPKDWTFDFLDYVLFFDCIYNPHLNAHLVSCLASLAERYPGMQCLFAQELRDQETLVDFLERVRPYFEVDLIKMEEINKTSVASSTNLPPANMSLFIMKPYNHEEYMLKALNEAKKCEPTDSAFCVGAVIVQNGKIVSTGYSRERPGNTHAEECAIEKFMLKNPTDSLEGAIMYSTMEPCSKRLSKKVSCTDLIVKQKFSTVVLGSLEPDIFVKCEGVDLLKKAGIVVIEKLTFQDDCLREAVRGHPPKH

SEQ ID NO: 1679 - protein, 366 aa, Leishmania mexicana
MSTKQHSAKDELLYLNKAVVFGSGAFGTALAMVLSKKCREVCVWHMNEEEVRLVNEKRENVLFLKGVQLASNITFTSDVEKAYNGAEIILFVIPTQFLRGFFEKSGGNLIAYAKEKQVPVLVCTKGIERSTLKFPAEIIGEFLPSPLLSVLAGPSFAIEVATGVFTCVSIASADINVARRLQRIMSTGDRSFVCWATTDTVGCEVASAVKNVLAIGSGVANGLGMGLNARAALIMRGLLEIRDLTAALGGDGSAVFGLAGLGDLQLTCSSELSRNFTVGKKLGKGLPIEEIQRTSKAVAEGVATADPLMRLAKQLKVKMPLCHQIYEIVYKKKNPRDALADLLSCGLQDEGLPPLFKRSASTPSKL

SEQ ID NO: 1680 - protein, 1178 aa, Caenorhabditis elegans
MGVDQLVETIIPYNLRSIATHLYVPPFTIITAIWTYVWLNIFGYEEYYELGMLGYAAIFVILALVLLFCHWMMPVRCFLMCSKQEDVRIASHVCVIPTQNNGWPELVKLMRTTRDKQTKLWFEFQRVHYTWDEESREFQTKTLDTAKPMVFFQKSHGFEVEEHVKDAKYLLGDNKTEMIVPQFLEMFIERATAPFFVFQVFCVGLWCLEDMWYYSLFTLFMLMTFEATLVKQQMKNMSEIRNMGNKTYMINVLRGKKWQKIKIEELVAGDIVSIGRGAEEECVPCDLLLLRGPCIVDESMLTGESVPQMKEPIEDVEKDKIFDIETDSRLHVIFGGTKIVQHTAPGKAAEGMVKSPDGNCICYVIRTGFNTSQGKLLRTIMFGVKKATANNLETFCFILFLLIFAIAAAAYLWIKGSVDETRSKYKLFLECTLILTSVIPPELPIELSLAVNSSLMALQKLGIFCTEPFRIPFAGKVDICCFDKTGTLTTDNLVVEGVALNNQKEGMIRNAEDLPHESLQVLASCHSLVRFEEDLVGDPLEKACLSWCGWNLTKGDAVMPPKTAAKGISGIKIFHRYHFSSAMKRMTVVAGYQSPGTSDTTFIVAVKGAPEVLRNMYADLPSDYDETYTRLTRQGSRVLAMGIRKLGETRVGELRDKKRENFENDLAFAGFVVISCPLKSDTKTMIREIMDSSHVVAMITGDNPLTACHVSKVLKFTKKSLPTLVLDEPADGVDWMWKSVDGTIELPLKPETKNKMERKAFFNSHEFCLTGSAFHHLVHNEHTFLRELILHVKVFARMAPKQKERIINELKSLGKVTLMCGDGTNDVGALKHANVGVALLTNPYDAEKAAEKEKEKKAKIEEARSLVRSGAQLPQRPGAPGAPPAANAARRDAPPGARARAPLPPMANAAQARLDNLMKELEEEEKAQVIKLGDASIAAPFTSKYTSIASICHVIKQGRCTLVTTLQMFKILALNALVSAYSLSALYLDGVKFSDTQATIQGLLLAACFLFISKSKPLKTLSRQRPMANIFNAYTLLTVTLQFIVHFSCLLYIVGLAHEANTEKAPVDLEAKFTPNILNTTVYIISMALQVCTFAVNYRGRPFMESLFENKAMLYSIMFSGGAVFTLASGQATDLMIQFELVVLPEALRNALLMCVTADLVICYIIDRGLNFLLGDMF

SEQ ID NO: 1681 - protein, 417 aa, Caenorhabditis elegans
MSSLNKLAIDQLNLAGKRVLIRVDFNVPLKDGKITNNQRIAAAVPTIQHALSNGAKSVVLMSHLGRPDGRRQDKYTLKPVAEELKALLKKDVLFLDDCVGSEVEAACADPAPGSVILLENLRYHLEEEGKGVDASGAKVKADSAAVKKFRESLTKLGDIYVNDAFGTAHRAHSSMVGVEHSQRASGFLLKNELSYFSKALDNPARPFLAILGGAKVADKIQLIKNLLDKVNEMIIGGGMAYTFLKVAQGVKIGNSLYDEEGAKIVNELLEAAKAKGVQIHLPVDFVIADKFAEDATSKTVTAEEGVPDGHMGLDVGPESSKIFAAAIQRAKTIVWNGPAGVFEFDKFATGTKSLMDEVVKATAAGAITIIGGGDTATAAKKYNTEDKVSHVSTGGGASLELLEGKVLPGVDALSPAQ

SEQ ID NO: 1682 - protein, 80 aa, Dugesia japonica
MGNLVTHLLDRLFGKKEMRILMVGLDAAGKTTILYKLKLGEIVTTIPTIGFNVETVEYKNISFTVWDVGGQDKIRPLWRH

SEQ ID NO: 1683 - protein, 83 aa, Dugesia japonica
MGNLVTHLLDRLFGKKEMRILMVGLDAAGKTTILYKLKLGEIVTTIPTIGFNVETVEYKNISFTVWDVGGQDKIRPLWRHYFQ

SEQ ID NO: 1684 - protein, 159 aa, Apium graveolens
MGVQKTVVEAPSTVSAEKMYQGFLLDMDTVFPKVLPQLIKSVEILEGDGGVGTVKLVHLGEATEYTTMKQKVDVIDKAGLAYTYTTIGGDILVDVLESVVNEFVVVPTDGGCIVKNTTIYNTKGDAVLPEDKIKEATEKSALAFKAVEAYLLANLQFLA

SEQ ID NO: 1685 - protein, 618 aa, Arabidopsis thaliana
MEGLIQTRGILSLPAKPIGVRRLLQPSHGLKQRLFTTNLPALSLSSNGHKKFQAFQQIPLGISVSHKERSRGFICKAEAAAAGGGNVFDEGDTAAMAVSPKIFGVEVTTLKKIVPLGLMFFCILFNYTILRDTKDVLVVTAKGSSAEIIPFLKTWVNLPMAIGFMLLYTKLSNVLSKKALFYTVIVPFIVYFGAFGFVMYPLSNLIHPEALADKLLATLGPRFMGPLAIMRIWSFCLFYVMAELWGSVVVSVLFWGFANQITTVDEAKKFYPLFGLGANVALIFSGRTVKYFSNMRKNLGPGVDGWAVSLKAMMSIVVGMGLAICFLYWWVNRYVPLPTRSKKKKVKPQMGTMESLKFLVSSPYIRDLATLVVAYGISINLVEVTWKSKLKAQFPSPNEYSAFMGDFSTCTGIATFTMMLLSQYVFKKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILTFGSLANSTPYLGVILLGIVTAWLAAAKSLEGQFNTLMSEEELEREMERASSVKIPVVSQEDAPSGETTSQLSEKSTPTGI

SEQ ID NO: 1686 - protein, 780 aa, Arabidopsis thaliana
MVEEDLNQIGGNSNYNGEGGDPESNTLNQPLVKANRTLSSTPLALVGAKVSHIESLDYEINENDLFKHDWRKRSKAQVLQYVFLKWTLACLVGLFTGLIATLINLAVENIAGYKLLAVGHFLTQERYVTGLMVLVGANLGLTLVASVLCVCFAPTAAGPGIPEIKAYLNGVDTPNMFGATTMIVKIVGSIGAVAAGLDLGKEGPLVHIGSCIASLLGQGGTDNHRIKWRWLRYFNNDRDRRDLITCGSAAGVCAAFRSPVGGVLFALEEVATWWRSALLWRTFFSTAVVVVVLREFIEICNSGKCGLFGKGGLIMFDVSHVTYTYHVTDIIPVMLIGVIGGILGSLYNHLLHKVLRLYNLINEKGKIHKVLLSLTVSLFTSVCLYGLPFLAKCKPCDPSIDEICPTNGRSGNFKQFHCPKGYYNDLATLLLTTNDDAVRNLFSSNTPNEFGMGSLWIFFVLYCILGLFTFGIATPSGLFLPIILMGAAYGRMLGAAMGSYTSIDQGLYAVLGAAALMAGSMRMTVSLCVIFLELTNNLLLLPITMIVLLIAKTVGDSFNPSIYDIILHLKGLPFLEANPEPWMRNLTVGELGDAKPPVVTLQGVEKVSNIVDVLKNTTHNAFPVLDEAEVPQVGLATGATELHGLILRAHLVKVLKKRWFLTEKRRTEEWEVREKFPWDELAEREDNFDDVAITSAEMEMYVDLHPLTNTTPYTVMENMSVAKALVLFRQVGLRHLLIVPKIQASGMCPVVGILTRQDLRAYNILQAFPLLEKSKGGKTH

SEQ ID NO: 1687 - protein, 93 aa, Arabidopsis thaliana
VVACLGCVYLHFKNRKSPHHIDRETKGGVWSKLRKPMLVKGPLGIVSVTEITFLAMFVALLLWCFITYLRNSFATITPKSAAAHDESLWQAKL

SEQ ID NO: 1688 - protein, 60 aa, Arabidopsis thaliana
VYLHFKNRKSPHHIDRETKGGVWSKLRKPMLVKGPLGIVSVTEITFLAMFVALLLWCFIT

SEQ ID NO: 1689 - protein, 81 aa, Arabidopsis thaliana
SIPEVDKLKAKFIAGRIIPAIATSTAMATGLVCLELYKVLDGGHKVEAYRNTFANLALPLFSMAEPLPPKVVKHRDMAWTV

SEQ ID NO: 1690 - protein, 80 aa, Arabidopsis thaliana
IPEVDKLKAKFIAGRIIPAIATSTAMATGLVCLELYKVLDGGHKVEAYRNTFANLALPLFSMAEPLPPKVVKHRDMAWTV

SEQ ID NO: 1691 - protein, 294 aa, Chenopodium rubrum
MDQYEKVEKIGEGTYGVVYKARDKVTNETIALKKIRLEQEDEGVPSTAIREISLLKEMQHGNIVRLQDVVHSEKRLYLVFEYLDLDLKKHMDSCPDFAKDPRMIKRFLYQILRGIAYCHSHRVLHRDLKPQNLLIDRQTNALKLADFGLARAFGIPVRTFTHEVVTLWYRAPEILLGSRHYSTPVDVWSVGCIFAEMVNQKPLFPGDSEIDELFKIFRTLGTPNEETWPGVTSLPDFKSSFPKWISKDLSAVVPNLDPAGIDLLNKMLCLDPSKRITARNALEHEYFKDIGFVP

SEQ ID NO: 1692 - protein, 199 aa, Cucumis sativus
NFLVKHGTLWKMTYYVTAPKVIHQSNFAATSTFIAREVAKGLMKYRPDIIISVHPLMQHVPIRILRSKGLLNKIVFTTVVTDLSTCHPTWFHKLVTRCYCPSTEVAKRALTAGLQPSKLKVFGLPVRPSFVKPIRPKIELRKELGMDENLPAVLLMGGGEGMGPIEATAKALSKALYDENHGEPIGQVLVICGHNKKLA

SEQ ID NO: 1693 - protein, 83 aa, Cucumis sativus
LMKYRPDIIISVHPLMQHVPIRILRSKGLLNKIVFTTVVTDLSTCHPTWFHKLVTRCYCPSTEVAKRALTAGLQPSKLKVFGL

SEQ ID NO: 1694 - protein, 485 aa, Mesembryanthemum crystallinum
MALAVEKTSSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGAGGGPDLIVDDGGDATLLIHEGVKAEEEYEKNGTIPDPTSTDNPEFQLVLGLIRDSLKVDPKRYHKMKTRLVGVSEETTTGVKRLYQMQATGTLLFPAINVNDSVTKSKFDNLYGCRHSLPDGLMRATDVMIAGKVGVVCGYGDVGKGCALALKAAGARVIVTEIDPICALQALMEGFQILTLEDVVSEADIFVTTTGNKDIIMVDHMRKMKNNAIVCNIGHFDNEIDMLGLENYPGVKRITIKPQTDRFVFPETNTGIIVLAEGRLMKLGCATGHPSFVMSCSFTNQVIAQLELWNERASGKYEKKVYVLPKHLDEKVAALHLGKLGAKLTKLSKDQADYISVPVEGPYKPAHYRY

SEQ ID NO: 1695 - protein, 106 aa, Mesembryanthemum crystallinum
ITIKPQTDRFVFPETNTGIIVLAEGRLMKLGCATGHPSFVMSCSFTNQVIAQLELWNERASGKYEKKVYVLPKHLDEKVAALHLGKLGAKLTKLSKDQADYISVPV

SEQ ID NO: 1696 - protein, 765 aa, Mesembryanthemum crystallinum
MASHIVGYPRMGPKRELKFALESFWDGKSTAEDLKKVSADLRSSIWKQMADAGIKYIPSNTFSYYDQVLDTTAMLGAVPPRYGWTGGEIEFDVYFSMARGNASVPAMEMTKWFDTNYHFIVPELGPEVNFSYASHKAVLEYKEAKALGVDTVPVLVGPVSYLLLSKQAKGVDKSFDLLSLLPKILPIYKEVVAELKEAGASWIQFDEPLLVMDLESHKLQAFSAAYADLESTLSGLNVVVETYFADVTAEAYKTLISLKGVTGYGFDLVRGTKTLDLVKAEFPSGKYLFAGVVDGRNIWANDLAASLATLEALEGVVGKDKLVVSTSCSFLHTAVDLINETKLDDEIKSWLAFAAQKVLEVNALAKALSGQKDEAFFSANAAALASRKSSPRVTNEAVQKAATALKGSDHRRATTVSSRLDAQQKKLNLPILPTTTIGSFPQTVELRRVRREYKAKKISEEEYVKAIKEEISKVVKLQEELDIDVLVHGEPERNDMVEYFGEQLSGFAFSANGWVQSYGSRCVKPPIIYGDVSRPNPMTVFWSSMAQSMTARPMKGMLTGPVTILNWSFVRNDQPRHETCYQIALAIKNEVEDLEKAGINVIQIDEAALREGLPLRKSEHDFYLKWAVHSFRITNVGVQDTTQIHTHMCYSNFNDIIHSIIDMDADVITIENSRSDEKLLSVFREGVKYGAGIGPGVYDIHSPRIPPTEELADRIRKMLAVLESNVLWVNPDCGLKTRKYGEVNPALSNMVAAAKQLRQELASAK

SEQ ID NO: 1697 - protein, 268 aa, Medicago truncatula
  MOD_RES (192)..(192): Any amino acid
  MOD_RES (199)..(199): Any amino acid
MAISHNTLAFTFGMLGNVISFLVFLAPISTFYRIYKKKSTEGFQSLPYLVALFSSMLWLYYALLKKDAFLLITINSFGCVVETIYIILYIIYAPRDARNLTFKLLSAMNVGSFALILIVTNYAVHGPLRVQVLGWVCVSLSVSVFAAPLSIVAQVVRTKSVEFMPFNLSFTLTLSATMWFGYGFFLKDICIXLPNVLGXVLGLLQMLLYAIYRNGGEKAMKKEKKAPIEPPKSIVIETQLEKIEQEKKNKDDDNEEKDKSEEPIGCGV

SEQ ID NO: 1698 - protein, 496 aa, Nicotiana plumbaginifolia
MAGNGVFVDIIEGDVFKYYSEGEWKKSASGKSVAIINPTTRKTQYKVQACTQEEVNKVMEVAKTAQKSWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSLVLKPPTQGAVACLHMVHCFHLAGFPKGLISCVTGKGSEIGDFLTMHPGVHCISFTGGDTGVAISKKAGMIPLQMELGGKDACIVLEDADLDLAAGSIVKGGFSYSGQRCTAVKVVLVMESVADALVEKVNAKVAKLTVGPPEDDCDITPVVSESSANFIEGLVMDAKQKNATFCQQYKREGNLIWPLLLDNVRPDMRIAWEEPFGPVLPVIRINSVEEGIHHCNASNFGLQGCVFTKDINKAILISDAMETGTVQINSAPARGPDHFPFQGIKDSGIGSQGITNSINMMTKVKTTVINLPTPSYTMG

SEQ ID NO: 1699 - protein, 187 aa, Nicotiana plumbaginifolia
QACTQEEVNKVMEVAKTAQKSWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSLVLKPPTQGAVACLHMVHCFHLAGFPKGLISCVTGKGSEIGDFLTM

SEQ ID NO: 1700 - protein, 166 aa, Nicotiana plumbaginifolia
WAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSLVLKPPTQGAVACLHMVHCFHLAGFPKGLISCVTGKGSEIGDFLTM

SEQ ID NO: 1701 - protein, 788 aa, Oryza sativa
MAPPAAAAAVTLGGKGAALTPAAVYALSHGLADPAIDCCASPLVRVADAVAALSCEAARGDVAAFDVPTSGDGLSAKDEADVAADVKMLLFGSKLVGAAGGADAASFTKVPTVNGIFREAVRALHARVRIELNAPVKLGKRDAVQTGEGKEEALVALATQLARPVQAMLKLSVARARLCVARIDDAELRKKLTDGVEIDDLKGMLGKVTIDSDAVSVLRGVYNSLLKFRDILAWEAAVAMAVIEMDSSIEKPQACEENEAGSSTENPHASGEKPKGDKKSKKKKTLGKGTSAVLMLLRDLVTNGKEVLSVNSALLAEWGTELSLLFDPKCPRLVSLVDKVKEIVETNEVRRLPKIPKGTRDFGKEQMAIREHAFSIITGVFKMHGAVSLDTPVFELRETLMGKYGEDSKLIYDLADQGGELCSLRYDLTVPFARYVAMNNISSLKRYQIAKVYRRDNPSKGRYREFYQCDFDIAGVYETMEPDFEVIKVLTELLDQLDIGTYEIKLNHRKLLDGMLEICGVPPEKFRTVCSSIDKLDKQTFEQVKKELVDEKGISNETADKIGDLVKTRGPPLEVLLELRKEGSKFMGNAGSVTALNELEILFKALDKANAIGKIVFDLSLARGLDYYTGVIYEAVFKGTTQVGSIAAGGRYDNLVGMFSGKQVPAVGVSLGIERVFAIMEQQEMEKNQIRATETEVLVSIIGKDLILAAELVSELWNAGIKAEFKLTTRIQNHLKYATQSGIPWMVLVGESEISSGKVKLKNLAASQEEEVDRTEFAQVLKQKLRNP

SEQ ID NO: 1702 - protein, 533 aa, Hordeum vulgare
MSDKKGVPARELPETPSWAVAVVFAAMVLVSVLMEHGLHKLGHWFQHRHKKALWEALEKMKAELMLVGFISLLLIVTQDPIIAKICISEDAADVMWPCKRGTEGRKPSKYVDYCPEGKVALMSTGSLHQLHVFIFVLAVFHVTYSVITIALSRLKMRTWKKWETETTSLEYQFANDPARFRFTHQTSFVKRHLGLSSTPGIRWVVAFFRQFFRSVTKVDYLTLRAGFINAHLSQNSKFDFHKYIKRSMEDDFKVVVGISLPLWGVAILTLFLDINGVGTLIWISFIPLVILLCVGTKLEMIIMEMALEIQDRASVIKGAPVVEPSNKFFWFHRPDWVLFFIHLTLFQNAFQMAHFVWTVATPGLKKCYHTQIGLSIMKVVVGLALQFLCSYMTFPLYALVTQMGSNMKRSIFDEQTSKALTNWRNTAKEKKKVRDTDMLMAQMIGDATPSRGSSPMPSRGSSPVHLLHKGMGRSDDPQSAPTSPRTQQEARDMYPVVVAHPVHRLNPNDRRRSASSSALEADIPSADFSFSQG

SEQ ID NO: 1703 - protein, 31 aa, Hordeum vulgare
FVWTVATPGLKKCYHTQIGLSIMKVVVGLAL

SEQ ID NO: 1704 - protein, 102 aa, Hordeum vulgare
KKALWEALEKMKAELMLVGFISLLLIVTQDPIIAKICISEDAADVMWPCKRGTEGRKPSKYVDYCPEGKVALMSTGSLHQLHVFIFVLAVFHVTYSVITIAL

SEQ ID NO: 1705 - protein, 502 aa, Arabidopsis thaliana
MGKVAVATTVVCSVAVCAAAALIVRRRMKSAGKWARVIEILKAFEEDCATPIAKLRQVADAMTVEMHAGLASEGGSKLKMLISYVDNLPSGDETGFFYALDLGGTNFRVMRVLLGGKHDRVVKREFKEESIPPHLMTGKSHELFDFIVDVLAKFVATEGEDFHLPPGRQRELGFTFSFPVKQLSLSSGTLINWTKGFSIDDTVDKDVVGELVKAMERVGLDMLVAALVNDTIGTLAGGRYTNPDVVVAVILGTGTNAAYVERAHAIPKWHGLLPKSGEMVINMEWGNFRSSHLPLTEYDHSLDVDSLNPGEQILEKIISGMYLGEILRRVLLKMAEEAAFFGDIVPPKLKIPFIIRTPNMSAMHSDTSPDLKVVGSKLKDILEVQTSSLKMRKVVISLCNIIASRGARLSAAGIYGILKKIGRDATKDGEAQKSVIAMDGGLFEHYTQFSESMKSSLKELLGDEVSESVEVILSNDGSGVGAALLAASHSQYLELEDDSETS

SEQ ID NO: 1706 - protein, 148 aa, Vicia faba
MEFTLRQEALVNSSWEAFNQNLPLFSVLFYTFILEKAPIAKNMFSVLKDANEIPLANPSINAHTEMVFEMVRDAAAQLQTTGQVVLGDTTLGVVHTQKRVDGLHFMVVKEALLKTIKEAVGDKWSEELSNAWEIAYDGLAVAIMKEMS

SEQ ID NO: 1707 - protein, 106 aa, Bacillus subtilis
MNKEKLSDHLKSEWKKIDQTANPSIPNQKELLHQLSQMKAEYRKKLLQEIILFVFCALMVVSAAILAFTQAPAVFIVLQVCVLAVLPILIAAEKKRHLGECEVKRG

SEQ ID NO: 1708 - protein, 204 aa, Bacillus subtilis
MKAEFKRKGGGKVKLVVGMTGATGAIFGVRLLQWLKAAGVETHLVVSPWANVTIKHETGYTLQEVEQLATYTYSHKDQAAAISSGSFDTDGMIVAPCSMKSLASIRTGMADNLLTRAADVMLKERKKLVLLTRETPLNQIHLENMLALTKMGTIILPPMPAFYNRPRSLEEMVDHIVFRTLDQFGIRLPEAKRWNGIEKQKGGA

SEQ ID NO: 1709 - protein, 560 aa, Bacillus subtilis
MAYTIGVDFGTLSGRAVLVHVQTGEELAAAVKEYRHAVIDTVLPKTGQKLPRDWALQHPADYLEVLETTIPSLLEQTGVDPKDIIGIGIDFTACTILPIDSSGQPLCMLPEYEEEPHSYVKLWKHHAAQKHADRLNQIAEEEGEAFLQRYGGKISSEWMIPKVMQIAEEAPHIYEAADRIIEAADWIVYQLCGSLKRSNCTAGYKAMWSEKAGYPSDDFFEKLNPSMKTITKDKLSGSIHSVGEKAGSLTEKMAKLTGLLPGTAVAVANVDAHVSVPAVGITEPGKMLMIMGTSTCHVLLGEEVHIVPGMCGVVDNGILPGYAGYEAGQSCVGDHFDWFVKTCVPPAYQEEAKEKNIGVHELLSEKANHQAPGESGLLALDWWNGNRSTLVDADLTGMLLGMTLLTKPEEIYRALVEATAYGTRMIIETFKESGVPIEELFAAGGIAEKNPFVMQIYADVTNMDIKISGSPQAPALGSAIFGALAAGKEKGGYDDIKKAAANMGKLKDITYTPNAENAAVYEKLYAEYKELVHYFGKENHVMKRLKTIKNLQFSSAAKKN

SEQ ID NO: 1710 - protein, 574 aa, Bacillus subtilis
MAHKTAGQAMTELLEQWGVDHVYGIPGDSINEFIEELRHERNQLKFIQTRHEEVAALAAAAEAKLTGKIGVCLSIAGPGAVHLLNGLYDAKADGAPVLAIAGQVSSGEVGRDYFQEIKLEQMFEDVAVFNREVHSAESLPDLLNQAIRTAYSKKGVAVLSVSDDLFAEKIKREPVYTSPVYIEGNLEPKKEQLVTCAQYINNAKKPIILAGQGMKKAKRELLEFADKAAAPIVVTLPAKGVVPDKHPHFLGNLGQIGTKPAYEAMEECDLLIMLGTSFPYRDYLPDDTPAIQLDSDPAKIGKRYPVTAGLVCDSALGLRELTEYIERKEDRRFLNACTEHMQHWWNEIEKDETEATTPLKPQQVVARLQEAAADDAVLSVDVGTVTVWMARHFKMNANQDFIVSSWLATMGCGLPGAIAASLSEPERQAIAVCGDGGFSMVMQDLPTAVKYKLPITVVILNNENLGMIEYEQQVKGNIDYVTKLQNVDYAAFAESCGAKGIKVTKAEELAPAFHEALHSDQPVVVDVMIGNEPPLPGKITYGQAKGFSKYMLKNFFENQKFEMPSLKKSLKRLF

SEQ ID NO: 1711 - protein, 421 aa, Bacillus subtilis
MKLFKNLTVQVITAVIIGVIVGLVWPDVGKEMKPLGDTFINAVKMVIAPIIFFTIVLGIAKMGDMKKVGKVGGKAFIYFEVVTTLALIIGLFVVNIMKPGAGLDYSKLEKGDVSQYTQNGGQGIDWIEFITHIVPSNMVDAFAKGDILQVLFFSILFGVGLAALGEKGKSVIDFFDKVSHVFFKIIGYIMRAAPIGAFGAMAYTIGHFGLDSIKPLASLMMSVYITMFLFVFVALNIICKLYGFSLWNYLRFIKDELLIVLGTSSSESVLPRMMDKMERYGCSKSVVGLVIPTGYSFNLDGTSIYLSMATVFLAQVFGVDLSIGQQITIILVLMLTSKGAAGVTGSGFIVLASTLSALQVIPLEGLALLLGVDRFMSEGRAIVNLIGNGIATIIVAKSENEFDEAKSIEAVEGMKKMKTAV

SEQ ID NO: 1712 - protein, 724 aa, Bacillus subtilis
MSKMLYTLGGWVARNRIKAICAWIVVLVAAIGLAVTLKPSFSEDMSIPDTPSEKAMDVIQKEFPHGPDKGSIRVIFGAGDGEKLTGKPAKKAIEDTFKEISKDDSVDSIASPFVTGTIAKDGTVAYADIQYKSSADDIKDYSIKHLKDSLKMADDEGLQTELSGDVPGAEMEIGGVSEIVGIILAFVVLAITFGSLLIAGLPILTALIGLGVSIGLVLIGTQVFDIASVSLSLAGMIGLAVGIDYALFIFTKHRQFLGEGIQKNESIARAVGTAGSAVVFAGLTVIVALCGLTVVNIPFMSAMGLTAGLSVLMAVLASITLVPAVLSIAGKRMIPKSNKKIEKQSTETNVWGRFVTKNPIMLSVCSILILIVISIPSMHLELGLPDAGMKAKDNPDRRAYDLLAEGFGEGFNGQLTIVADATNATENKAEAFADAVKEIKGLDHVASVTPAMPNKEGNFAIITVVPETGPNDVTTKDLVHDVRSLSDKNGVDLLVTGSTAVNIDISDRLNDAIPVFAVLIVGFAFVLLTIVFRSLLVPLVAVAGFMLTMTATLGICVFVLQDGNLIDFFKIPEKGPILAFLPILSIGILFGLAMDYQVFLVSRMREEYVKTNNPVQAIQAGLKHSGPVVTAAGLIMIFVFAGFIFAGEASIKANGLALSFGVLFDAFIVRMTLIPSVMKLMGNAAWYLPKWLDKIIPNVDIEGHQLTKEIQPEIDHEQKKQISV

SEQ ID NO: 1713 - protein, 413 aa, Mesocricetus auratus
MKPSISWGILLLAGLCCLVPSFLAEDAQETDASKQDQEHQACCKIAPNLADFSFNLYRELVHQSNTTNIFFSPVSIATAFAMLSLGTKGVTHTQILEGLGFNLTEIAEAEVHKGFHNLLQTFNRPDNELQLTTGNGLFIHNNLKLVDKFLEEVKNDYHSEAFSVNFTDSEEAKKVINGFVEKGTQGKIVDLVKDLDKDTVLALVNYIFFKGKWKKPFDADNTEEADFHVDKTTTVKVPMMSRLGMFDVHYVSTLSSWVLLMDYLGNATAIFILPDDGKMQHLEQTLNKEIIGKFLKDRHTRSANVHFPKLSISGTYNLKTALDPLGITQVFSNGADLSGITEDVPLKLGKAVHKAVLTIDERGTEAAGATFMEIIPMSVPPEVNFNSPFIAIIYDRQTAKSPLFVGKVVDPTR

SEQ ID NO: 1714 - protein, 385 aa, Mus musculus
MVLKMGPVGAEADENQTVEVKVEPYGPGHTTPRGELPPDPEPELIDSTKLVEVQVILILAYCSIILLGVVGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSVYGTVYSLSTLLILYVLPLGIISFSYTRIWSKLRNHVSPGAASDHYHQRRHKMTKMLVCVVVVFAVSWLPLHAFQLAVDIDSHVLDLKEYKLIFTVFHIIAMCSTFANPLLYGWMNSNYRKAFLSAFRCEQRLDAIHSEVSMTFKAKKNLEVKKNNGPTDSFSEATNV

SEQ ID NO: 1715 - protein, 852 aa, Mus musculus
MAEEGTGVRCWLLQLQEFLSAADRCSAAGASYQLIRSLGQECVLSTSSAVQALQISLVFSRDFGLLVFIRKSLSIEDFRDCREEALKFLCVFLEKIDQKVMHYSLDIKNTCTSVYTKDRTAKCKIPALDLLIKLLQILRSTRLMDEFKIGELFNKFYGELASKSKLPDTVLEKVYELLGVLGEVHPSEMINHSENLFRAFLGELKTQMTSTVREPKFPVLAGCLKGLSSLLCNFTKSMEEDPQTSKEIFGFTFKAIRPQIEMKRYAVPLAGLRLLTLHASQFTACLLDNYITLFEVLSKWCSHTNVELKKAAHSALESFLRQISFTVAEDAELHKSRLKYFMEQFYGIIRNTDSNNKELAIAIRGYGLFAGPCKVINAKDVDFMYVELIQRCKQMFLTHADASEDHVYQMPSFLQSIASVLLYLDTVPEVYTPVLEHLMVVQIDSFPQYSPKMQLVCCKAIIKLFLALSEKGPVHWNCISAVVHQGLIRICSKPVVLQKDVESRSDNRSASEEVRTGRWKVPTYKDYVDLFQHLLGCDQMEDFILGDETFLFVNSSLKSLNHLLYDEFIRSVLKIVEKLDLTLEKQTVGEQEDGSTADVWVIPTSDPAANLHPAKPSDFSALINLVEFCREILPRKHVGFFEPWVYSFAYELILQSTRLPLISGFYKLLSIAVKNARKIKYFEGISPKSLKHSPEDTEKYSCFALFAKFGKEVSVKMKQYKDELLASCLTFVLSLPHDIIELDVRAYVPALQMAFKLGLSHMPLAEIGLHALKEWSVHIDKSILQPYYKDILPCLDGYLNTSTLSDETKSHWGLSALSRAAQKGFNRHVVKHLKRTRNSSPVRNPFLILYLK

SEQ ID NO: 1716 - protein, 325 aa, Rattus norvegicus
MATVRKAFPQRLVGLASLRAASTSSMGTLPKRVKIVEVGPRDGLQNEKSIVPTPVKIKLIDMLSEAGLPVIEATSFVSPKWVPQMADHSDVLKGIQKFPGINYPVLTPNMKGFEEAVAAGAKEVSIFGAASELFTRKNVNCSIEESFQRFDGVMQAARAASISVRGYVSCALGCPYEGKVSPAKVAEVAKKLYSMGCYEISLGDTIGVGTPGLMKDMLTAVLHEVPVAALAVHCHDTYGQALANTLVALQMGVSVVDSSVAGLGGCPYAKGASGNLATEDLVYMLTGLGIHTGVNLQKLLEAGDFICQALNRKTSSKVAQATCKL

SEQ ID NO: 1717 - protein, 154 aa, Rattus norvegicus
YTVACQHRSSSEIICCTTPSLRQLDLQLPLKTKAFFLLDGILSKHFDLTYVHDPMFKPFEKPVMISMGNENVVEIKGDDIDPEAVKGEVLKVGNKSCENLHWHSEALLCTVPSDLLKLNGGELNIEWKQAVSSTVLGKVIVQPDQNFAGLIIGA

SEQ ID NO: 1718 - protein, 620 aa, Rattus norvegicus
MLPVLYTGLAGLLLLPLLLTCCCPYLLQDVRFFLQLANMARQVRSYRQRRPVRTILHVFLEQARKTPHKPFLLFRDETLTYAQVDRRSNQVARALHDHLGLRQGDCVALFMGNEPAYVWLWLGLLKLGCPMACLNYNIRAKSLLHCFQCCGAKVLLASPELHEAVEEVLPTLKKEGVSVFYVSRTSNTNGVDTVLDKVDGVSADPIPESWRSEVTFTTPAVYIYTSGTTGLPKAATINHHRLWYGTSLALRSGIKAHDVIYTTMPLYHSAALMIGLHGCIVVGATFALRSKFSASQFWDDCRKYNATVIQYIGELLRYLCNTPQKPNDRDHKVKIALGNGLRGDVWREFIKRFGDIHIYEFYASTEGNIGFMNYPRKIGAVGRENYLQKKVVRHELIKYDVEKDEPVRDANGYCIKVPKGEVGLLICKITELTPFFGYAGGKTQTEKKKLRDVFKKGDVYFNSGDLLMIDRENFIYFHDRVGDTFRWKGENVATTEVADIVGLVDFVEEVNVYGVPVPGHEGRIGMASIKMKENYEFNGKKLFQHISEYLPSYSRPRFLRIQDTIEITGTFKHRKVTLMEEGFNPSVIKDTLYFMDDTEKTYVPMTEDIYNAIIDKTLKL

SEQ ID NO: 1719 - protein, 246 aa, Rattus norvegicus
MKALLFLMALLLPSGAGAEEIIGGVESIPHSRPYMALLKIVTEEGHVTFCGGFLISLQFVLTAAHCHGREITVTLGAHDMSKRESTQQKIKVVKQIFPLKYNLFSNFRDIMLLKLEQKAVLTPSVNVIPLPQSSDIIKPGTMCLAAGWGQTGVKEPNSNTLREVMLRIMEMKACKDYRHYDNRFQICVGIPQMLKLAYKGDSGGPLVCAGVAHGIVSHGPGRGIPPIIFTRISSYVSWINRVIRGN

SEQ ID NO: 1720 - protein, 113 aa, Mus musculus; identical to SEQ ID NO: 854

SEQ ID NO: 1721 - protein, 120 aa, Mus musculus; identical to SEQ ID NO: 783

SEQ ID NO: 1722 - protein, 112 aa, Mus musculus
LRLSHEALKQICLSGLHSWKKKFIRFKNGIITGVFPASPSSWLIVVVGVISSMHTKVDPSLGMIAKINRTLDTTGRMSSQTKNIVSGVLFGTGLWVAIIMTMRYSLKVLLSY

SEQ ID NO: 1723 - protein, 125 aa, Mus musculus
QAVAFQFTVTPDGIDLRLSHEALKQICLSGLHSWKKKFIRFKNGIITGVFPASPSSWLIVVVGVISSMHTKVDPSLGMIAKINRTLDTTGRMSSQTKNIVSGVLFGTGLWVAIIMTMRYSLKVLL

SEQ ID NO: 1724 - protein, 33 aa, Rattus norvegicus
KALDVWATGVTLYCFVYGKCPFIDEYILALHRK

SEQ ID NO: 1725 - protein, 73 aa, Rattus norvegicus
ATGVTLYCFVYGKCPFIDEYILALHRKIKNEAVVFPEEPEVSEELKDLILKMLDKNPETRIGVSDIKLHPWVT

SEQ ID NO: 1726 - protein, 467 aa, Mus musculus
MASQNSFRVEFDTFGELKVPTDKYYGAQTVRSTMNFKIGGATERMPIPVIQAFGILKRAAAEVNQEYGLDPKIASAIMKAADEVAEGKLNDHFPLVVWQTGSGTQTNMNVNEVISNRAIEMLGGELGSKKPVHPNDHVNKSQSSNDTFPTAMHIAAAVEVHKVLLPGLQKLHDALSAKSKEFAQVIKIGRTHTQDAVPLTLGQEFSGYVQQVQYAMVRIKAAMPRIYELAAGGTAVGTGLNTRIGFAEKVAAKVAALTGLPFVTAPNKFEALAAHDALVELSGAMNTAACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTDNCVVGIQANTERINKLMNESLMLVTALNPHIGYDKAAKIAKTAHKNGSTLKETAIELGYLTAEQFDEWVKPKDMLGPK

SEQ ID NO: 1727 - protein, 303 aa, Rattus norvegicus
MWPLAAALLLGSCCCGSAQLLLSKVKSVEFTSCNDTVVIPCKVLNVEAQSTDEMFVKWKLNKSYIFIYDGNKNSTTREQNFTSAKISVSDLLKGIASLTMDTHEAVVGNYTCEVTELSREGKTVIELKNRPVSWFSTNEKILIVIFPILAILLFWGKFGILTLKYKSSHTNKRIILLLVAGLALTLIVVVGAILFIPGEKPVKNASGLGLIVISTGILILLQYNVFMTAFGMTSFTIAILITQVLGYVLAVVGMCLCIMACEPVHGPLLISGLGIIALAELLGLVYMKFVASNQRTIQPPRNN

SEQ ID NO: 1728 - protein, 318 aa, Rattus norvegicus
MWPLAAARSCCCGSAQLLLSKVKSVEFTSCNDTVVIPCKVLNVEAQSTDEMFVKWKLNKSYIFIYDGNKNSTTREQNFTSAKISVSDLLKGIASLTMDTHEAVVGNYTCEVTELSREGKTVIELKNRPVSWFSTNEKILIVIFPILAILLFWGKFGILTLKYKSSHTNKRIILLLVAGLALTLIVVVGAILFIPGEKPVKNASGLGLIVISTGILILLQYNVFMTAFGMTSFTIAILITQVLGYVLAVVGMCLCIMACEPVHGPLLISGLGIIALAELLGLVYMKFVASNQRTIQPPRKAVEEPLNAFKESKGMMNDE

SEQ ID NO: 1729 - protein, 225 aa, Mus musculus
MVSSNSALQFVNYPTQVLGKSCKPIPVMLLGVTLLKKKYPLAKYLCVLLIVAGVALFMYKPKKVVGIEEHTVGFGELLLLMSLTLDGLTGVSQDHMRAHYQTGSNHMMLNINLWSTFLLGAGILFTGELWEFLSFAERYPTIIYNILLFGLTSALGQSFIFMTVVYFGPLTCSIITTTRKFFTILASVILFANPISSMQWVGTVLVFLGLGLDAKFGKGTKKTSH

SEQ ID NO: 1730 - protein, 162 aa, Mus musculus
MAPIKVGDAIPSVEVFEGEPGKKVNLAELFKGKKGVLFGVPGAFTPGCSKTHLPGFVEQAGALKAKGAQVVACLSVNDVFVIEEWGRAHQAEGKVRLLADPTGAFGKATDLLLDDSLVSLFGNRRLKRFSMVIDNGIVKALNVEPDGTGLTCSLAPNILSQL

SEQ ID NO: 1731 - protein, 328 aa, Staphylococcus aureus; identical to SEQ ID NO: 1549

SEQ ID NO: 1732 - protein, 319 aa, Staphylococcus aureus; identical to SEQ ID NO: 1540

SEQ ID NO: 1733 - protein, 230 aa, Staphylococcus aureus; identical to SEQ ID NO: 1545

SEQ ID NO: 1734 - protein, 241 aa, Escherichia coli
MAKIHMVLQGKGGVGKSAIAAIIAQYKMDKGQTPLCIDTDPVNATFEGYKALNVRRLNIMAGDEINSRNFDTLVELIAPTKDDVVIDNGASSFVPLSHYLISNQVPALLQEMGHELVIHTVVTGGQALLDTVSGFAQLASQFPAEALFVVWLNPYWGPIEHEGKSFEQMKAYTANKARVSSIIQIPALKEETYGRDFSDMLQERLTFDQALADESLTIMTRQRLKIVRRGLFEQLDAAAVL

SEQ ID NO: 1735 - protein, 88 aa, Xenopus laevis
QELVLTSKLINHWYESLATSIVDLYMPTFSISGKVVLKDTLRKMGISDIFTDKADLTGISEQIKLKVSMASHNAVLNVNEFGTEAVGA

SEQ ID NO: 1736 - protein, 79 aa, Xenopus laevis
LVLTSKLINHWYESLATSIVDLYMPTFSISGKVVLKDTLRKMGISDIFTDKADLTGISEQIKLKVSMASHNAVLNVNEF

SEQ ID NO: 1737 - protein, 306 aa, Mus musculus
MACNCQLMQDTPLLKFPCPRLILLFVLLIRLSQVSSDVDEQLSKSVKDKVLLPCRYNSPHEDESEDRIYWQKHDKVVLSVIAGKLKVWPEYKNRTLYDNTTYSLIILGLVLSDRGTYSCVVQKKERGTYEVKHLALVKLSIKADFSTPNITESGNPSADTKRITCFASGGFPKPRFSWLENGRELPGINTTISQDPESELYTISSQLDFNTTRNHTIKCLIKYGDAHVSEDFTWEKPPEDPPDSKNTLVLFGAGFGAVITVVVIVVIIKCFCKHRSCFRRNEASRETNNSLTFGPEEALAEQTVFL

SEQ ID NO: 1738 - protein, 212 aa, Mus musculus
MACNCQLMQDTPLLKFPCPRLILLFVLLIRLSQVSSDVDEQLSKSVKDKVLLPCRYNSPHEDESEDRIYWQKHDKVVLSVIAGKLKVWPEYKNRTLYDNTTYSLIILGLVLSDRGTYSCVVQKKERGTYEVKHLALVKLSIKAPEDPPDSKNTLVLFGAGFGAVITVVVIVVIIKCFCKHRSCFRRNEASRETNNSLTFGPEEALAEQTVFL

SEQ ID NO: 1739 - protein, 365 aa, Populus tremuloides
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHVDVIMLAHNPGGKERTEKEFEGLAKGAGFQGFEVMCCAFNTHVIEFRKKA

SEQ ID NO: 1740 - protein, 607 aa, Solanum tuberosum
MASITASHHFVSRSQTSLDTKSTLSQIGLRNHTLTHNGLRAVNKLDGLQSRTNTKVTPKMASRTETKRPGCSATIVCGKGMNLIFVGTEVGPWSKTGGLGDVLGGLPPALAARGHRVMTISPRYDQYKDAWDTSVAVEVKVGDSIEIVRFFHCYKRGVDRVFVDHPMFLEKVWGKTGSKIYGPKAGLDYLDNELRFSLLCQAALEAPKVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDSVLRKTCITGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAKFNVPLAHMITAGADFMLVPSRFEPCGLIQLHAMRYGTVPICASTGGLVDTVKEGYTGFHMGAFNVECDVVDPADVLKIVTTVARALAVYGTLAFAEMIKNCMSEELSWKEPAKKWETLLLGLGASGSEPGVEGEEIAPLAKENVATP

SEQ ID NO: 1741 - protein, 412 aa, Mus musculus
MTPSISWGLLLLAGLCCLVPSFLAEDVQETDTSQKDQSPASHEIATNLGDFAISLYRELVHQSNTSNIFFSPVSIATAFAMLSLGSKGDTHTQILEGLQFNLTQTSEADIHKSFQHLLQTLNRPDSELQLSTGNGLFVNNDLKLVEKFLEEAKNHYQAEVFSVNFAESEEAKKVINDFVEKGTQGKIVEAVKKLDQDTVFALANYILFKGKWKKPFDPENTEEAEFHVDESTTVKVPMMTLSGMLDVHHCSTLSSWVLLMDYAGNATAVFLLPDDGKMQHLEQTLSKELISKFLLNRRRRLAQIHFPRLSISGEYNLKTLMSPLGITRIFNNGADLSGITEENAPLKLSQAVHKAVLTIDETGTEAAAVTVLLAVPYSMPPILRFDHPFLFIIFEEHTQSPLFVGKVVDPTH

SEQ ID NO: 1742 - protein, 413 aa, Mus musculus
MTPSISWSLLLLAGLCCLVPSFLAEDVQETDTSQKDQSPASHEIATNLGDFALRLYRELVHQSNTSNIFFSPVSIATAFAMLSLGSKGDTHTQILEGLQFNLTQTSEADIHKSFQHLLQTLNRPDSELQLSTGNGLFVNNDLKLVEKFLEEAKNHYQAEVFSVNFAESEEAKKVINDFVEKGTQGKIVEAVKKLDQDTVFALANYILFKGKWKQPFDPENTEEAEFHVDESTTVKVPMMTLSGMLDVHHCSMLSSWVLLMDYAGNTTAVFLLPDDGKMQHLEQTLNKELISQFLLNRRRSDAQIHIPRLSISGNYNLKTLMSPLGITRIFNNGADLSGITEENAPLKLSKAVHKAVLTIDETGTEAAAATVLQVATYSMPPIVRFDHPFLFIIFEEHTQSPIFVGKVVDPTHK

SEQ ID NO: 1743 - protein, 125 aa, Mus musculus
APNQAHLRILKETEFKKIKVLGSGAFGTVYKGLWIPEGEKVKIPVAIKELREATSPKANKEILDEAYVMASVDNPHVCRLLGICLTSTVQLITQLMPYGCLLDYVREHKDNIGSQYLLNWCVQIA

SEQ ID NO: 1744 - protein, 152 aa, Mus musculus
TEFKKIKVLGSGAFGTVYKGLWIPEGEKVKIPVAIKELREATSPKANKEILDEAYVMASVDNPHVCRLLGICLTSTVQLITQLMPYGCLLDYVREHKDNIGSQYLLNWCVQIAKGMNYLEDRRLVHRDLAARNVLVKTPQHVKITDFGLAKL

SEQ ID NO: 1745 - protein, 389 aa, Pisum sativum
MVSVSEIRKPQRAEGPATILAIGTANPANCVEQSTYPDFYFKITNSEHKTVLKEKFQRMCDKSMIKRRYMYLTEEILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREQGLTFHLLKDVPGIVSKNIDKALVEAFKPLGISDYNSIFWIAHPGGPAILDQVEQKLGLKPEKMRATREVLSEYGNMSSACVLFILDQMRKKSTQDGLNTTGEGLEWGVLFGFGPGLTIETVVLHSVAI

SEQ ID NO: 1746 - protein, 389 aa, Pisum sativum
MVTVSEIRKAQRAEGPATILAIGTANPANCVEQSTYPDFYFKITNSEHKTVLKEKFQRMCDKSMIKRRYMYLTEDILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVFRLAKDLAENNKNARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNIDKALVEAFKPLGISDYNSIFWIAHPGGPAILDQVEQKLALKPEKMRATREVLSEYGNMSSACVLFILDEMRKKSTQDGLNTTGEGLEWGVLFGFGPGLTIETVVLRSVAI

SEQ ID NO: 1747 - protein, 389 aa, Pisum sativum
MVSVSEIRKAQRAEGPATILAIGTATPANCVEQSTYPDFYFKITNSEHKTVLKEKFQRMCDKSMIKRRYMYLTEEILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPLPEIEKPIFEMVWTAQTIAPDSEGAIDGHLREAGLTFHLLKDVPGIVSKNINKALVEAFQPLNIDDYNSIFWIAHPGGPAILDQVEEKLGLKPEKMKATREVLSEYGNMSSACVLFILDEMRKKSAQQGLKTTGEGLDWGVLFGFGPGLTIETVVLHSVAI

SEQ ID NO: 1748 - protein, 190 aa, Oncorhynchus mykiss
VITTVILCLVSRVLGVIGLTFIINKFRIVKLTKKDQFIVAYGGLRGAIAFSLGYLLSNSHQMRNLFLTAIITVIFFTVFVQGMTIRPLVELLAVKKKKESKPSINEEIHTEFLDHLLTGVEGVCGHYGHYHWKEKLNRFNKTYVKRWLIAGENFKEPELIAFYRKMELKQAIMMVESGQLPSVLPSTISM

SEQ ID NO: 1749 - protein, 193 aa, Oncorhynchus mykiss
TTVILCLVSRVLGVIGLTFIINKFRIVKLTKKDQFIVAYGGLRGAIAFSLGYLLSNSHQMRNLFLTAIITVIFFTVFVQGMTIRPLVELLAVKKKKESKPSINEEIHTEFLDHLLTGVEGVCGHYGHYHWKEKLNRFNKTYVKRWLIAGENFKEPELIAFYRKMELKQAIMMVESGQLPSVLPSTISMQNIQP

SEQ ID NO: 1750 - protein, 415 aa, Drosophila melanogaster
MAFNKLSIENLDLAGKRVLMRVDFNVPIKEGKITSNQRIVAALDSIKLALSKKAKSVVLMSHLGRPDGNKNIKYTLAPVAAELKTLLGQDVIFLSDCVGSEVEAACKDPAPGSVILLENVRFYVEEEGKGLDASGGKVKADPAKVKEFRASLAKLGDVYVNDAFGTAHRAHSSMMGDGFEQRAAGLLLNKELKYFSQALDKPPNPFLAILGGAKVADKIQLIENLLDKVNEMIIGGGMAFTFLKVLNNMKIGGSLFDEEGSKIVEKLVEKAKKNNVQLHLPVDFVCGDKFAENAAVSEATVEAGIPDGHMGLDVGPKTRELFAAPIARAKLIVWNGPPGVFEFPNFANGTKSIMDGVVAATKNGTVSIIGGGDTASCCAKWNTEALVSHVSTGGGASLELLEGKTLPGVAALTSA

SEQ ID NO: 1751 - protein, 493 aa, Drosophila melanogaster [sequence omitted]

SEQ ID NO: 1752 - protein, 545 aa, Desulfovibrio desulfuricans
MSNAMFCYQCQETVGNKGCTQVGVCGKKPETAALQDALIYVTKGLGQIATRLRAEGKAVDHRIDRLVTGNLFATITNANFDDDILAERVRMTCAAKKELAASLTDKSGLSDAALWEASEKSAMLAKAGTVGVMATTDDDVRSLRWLITFGLKGMAAYAKHADVLGKHENSLDAFMQEALAKTLDDSLSVADLVALTLETGKFGVSAMALLDAANTGTYGHPEITKVNIGVGSNPGILISGHDLRDLEMLLKQTEGTGVDVYTHSEMLPAHYYPAFKKYAHFKGNYGNAWWKQKEEFESFNGPVLLTTNCLVPPKDSYKDRVYTTGIVGFTGCKHIPGEIGEHKDFSAIIAHAKTCPAPTEIESGEIIGGFAHNQVLALADKVIDAVKSGAIKKFVVMAGCDGRAKSRSYYTDFAEGLPKDTVILTAGCAKYRYNKLNLGDIGGIPRVLDAGQCNDSYSLAVIALKLKEVFGLEDVNDLPIVYNIAWYEQKAVIVLLALLSLGVKNIHLGPTLPAFLSPNVAKVLVEQFNIGGITSPQDDLKAFFG

SEQ ID NO: 1753 - protein, 485 aa, Petroselinum crispum
MALSVEKTAAGREYKVKDMSLADFGRLELELAEVEMPGLMSCRTEFGPSQPFKGARITGSLHMTIQTGVLIETLTALGAEVRWCSCNIFSTQDHAAAAIARDSCAVFAWKGETLQEYWWCTERALDWGPDGGPDLIVDDGGDATLLIHEGVKAEEEYKKSGAIPDPASTDNAEFQIVLSIIRDGLKSDPMKYHKMKDRLVGVSEETTTGVKRLYQMQQNGTLLFPAINVNDSVTKSKFDNLYGCRHSLPDGLMRATDVMIAGKVALIAGYGDVGKGCAAAMKQAGARVIVTEIDPICALQATMEGLQVLPLEDVVSEVDIFVTTTGNKDIIMVSDMRKMKNNAIVCNIGHFDNEIDMLGLETYPGVKRITIKPQTDRWVFPDTGRGIIILAEGRLMNLGCATGHPSFVMSCSFTNQVIAQLELWNEKSSGKYEKKVYVLPKHLDEKVAALHLGKLGAKLTKLSKDQADYISVPVEGPYKPAHYRY

SEQ ID NO: 1754 - protein, 32 aa, Mus musculus; identical to SEQ ID NO: 849

SEQ ID NO: 1755 - protein, 148 aa, Mus musculus; identical to SEQ ID NO: 850

SEQ ID NO: 1756 - protein, 378 aa, Haliotis diversicolor
MADIQLSKYHVSKDIGFLLEPLQDVLPDYFAPWNRLAKSLPDLVASHKFRDAVKEMPLLDSSKLAGYRQKRLAHLQLVLITSGYLWQEGEGGAVQRLPECVAKPLWNVSNDLGLKPVLTYGDVCLTNCRVKGGDIEVMYNLPGGAGTEWFLKVCGLVELTLGKGAQSVQNVLDGAKANDKAKMTSGLTELTTTIGNMQAALAKMNDNLTPDHFYNVLRPFLGGFGGPASPISGGLIYEGVSDAPVTMIGGSAAQSSAMQLLDNLLGVTHSPDKQAFLDEISNYMIPAHKQLLADLTKMPRKVPQIVAEAKDANLSKAYSGCVAALTQYRTYHIQVVTKYIVTASKSDSPKSLAYKDTGKSDLIPFLKEVRDDTEKMQK

SEQ ID NO: 1757 - protein, 62 aa, Oryza sativa
YMSSQGDINEKMRAILIDWLIEVHHKFELMDETLFLTVNIVDRFLEKQVVPRKKLQLVGVTA

SEQ ID NO: 1758 - protein, 55 aa, Oryza sativa
ILIDWLIEVHHKFELMDETLFLTVNIVDRFLEKQVVPRKKLQLVGVTAMLLACKY

SEQ ID NO: 1759 - protein, 157 aa, Schizosaccharomyces pombe
MQSQLIPAFLVTTDTKAQGFLAYALQEFLKLGGFKSAVINKKKGLTVVTEHWMSLPDLSKRVLIPFLTSKYHLTPIPKIDIRYPIYKENVTIHTWMQLFSLKLMEYAHSQNAEKIFGICSKVVKDQEVNIPCFLLPFLVLNVILTESELEVNKVIEE

SEQ ID NO: 1760 - protein, 112 aa, Schizosaccharomyces pombe
KGLTVVTEHWMSLPDLSKRVLIPFLTSKYHLTPIPKIDIRYPIYKENVTIHTWMQLFSLKLMEYAHSQNAEKIFGICSKVVKDQEVNIPCFLLPFLVLNVILTESELEVNKV

SEQ ID NO: 1761 - protein, 317 aa, Psychrobacter immobilis
MLLKRLCFAALFSLSMVGCTNAPNALAVNTTQKIIQYERNKSDLEIKSLTLASGDKMVYAENGNVAGEPLLLIHGFGGNKDNFTRIARQLEGYHLIIPDLLGFGESSKPMSADYRSEAQRTRLHELLQAKGLASNIHVGGNSMGGAISVAYAAKYPKDVKSLWLVDSAGFWSAGIPKSLEGATLENNPLLIKSNEDFYKMYDFVMYKPPYLPKSVKAVFAQERIKNKELDAKILEQIVTDNVEERAKIIAQYKIPTLVVWGDKDQIIKPETVNLIKKIIPQAQVIMMEDVGHVPMVEALDETADNYKAFRSILEAQR

SEQ ID NO: 1762 - protein, 271 aa, Mus musculus
MNWSVFEGLLSGVNKYSTAFGRIWLSLVFVFRVLVYLVTAERVWGDDQKDFDCNTRQPGCTNVCYDEFFPVSHVRLWALQLILVTCPSLLVVMHVAYRKAREKKYQEKIGEGYLYPNPGKKRGGLWWTYVFSLSFKATIDIIFLYLFHAFYPRYTLPSMVKCHAEPCPNTVDCFIAKPSEKNIFIVFMVVTAVICILLNLVELIYLVIKRCSECAQLRRPPTAHAKNDPNWANSPSKEKDFLSCDLIFLGSDAHPPLLPDRPRAHVKKTIL

SEQ ID NO: 1763 - protein, 210 aa, Saccharomyces cerevisiae
MFSYSDFCSIGTAMILSATTFLMGVFFSNMPYDYHLLFNPNSTQEHFDLALRHYQILHETPLPVIVTLCVVAGIGLVGGTIKVFKPNPELQMFEYCSLGLYVLAICVFLTNVKTGIDCSVSHNWGEVTENQGLAVIASSNIILLVMFAGVIILQIGLWYSNWDLQKRLKEFYAQEEREAANAGKKTEKVDNAKKNDNKSKGAQKRKNAKK

SEQ ID NO: 1764 - protein, 365 aa, Saccharomyces cerevisiae
MVLAKQWVLKNLPTPGEPFNFHFHDPACTFELIEKELSSEQLKDGELLLETTYLSNDPAQKFWISSMDKNYAKGVQPGEIIPARGIGKVLASRNKAFSPGDYVSAVTGWTTHAIISQENVQGLRKLDKNKVGKLWWYLSVLGGTSLTAYFIFFTYAQLQEREEDYGKVYLISGAAGAVGTVCIQLALNVFKASKVIAIAGGPEKVAFVESFGDNVVGVDYKDPSFKQKLIEAAGGENTVDYFIDNVGSNVLEAGVLLLKQRAMLIACGAISAYNDPSKFVFKGYSFILTKRLVVKGVLVTDNIDDFPKALDKLGSLVKHGKIDLLKSATLEDGTGDKFKNVPLIWKGLFSGVNKGKLITKVNNEE

SEQ ID NO: 1765 - protein, 407 aa, Trichomonas vaginalis
MLSSSFARNFNILEWQSKEICAKYNVAAGINLVARSPEEAAEAFRKMNLPAAVIKAQVYCGGRGKGHWLETGFKSGVHFVKSADEAAKIAKEMLGHHLVTKQTGKDGLLCQAVMLSDPVEVKRELYFAILLDRQTQSPVVIASTEGGVEIEEVAAHHPEKIHKFVLDGVEGITEEVAKNISTKLGLTGKAYDNGVVEMQKLWKLFVGSDATQVEVNPLAETTDGRIITVDSKFNFDDSAHYRQKQIFGYRDLKQVNPFEIRAEKYGLNYVPLDGNVACLVNGAGLAMATMDVIKLAGGDPANFLDLGGAASEAAVTEGFTIISQQSHVKAILVNIFGGIVRCDMVAAGVIAAFKKVGLKVPLVVRLEGTNVEAGKKLIRESGLPIISADNLTDAGEKAVKAAKGEKF

SEQ ID NO: 1766 - protein, 400 aa, Bombyx mori
MDKLLLLVTLVCGTQAFYMFGHEFSRTRLGDTIDKTSLKILKESYNLADDKNVIASPLGVMLLLSLYESGAGAQSKEEIREILGGGEAQESSHTYGLLNQRYAEFDPKFLTVAIKIYVSDQYKLADAFSRTANLFRSEVDNINFSAPKNAADIINRWADEQTQGHIKTPVSEDKIDPATAVAMFNVIFFQGHWHVPFNASETEEKDFHVDEKTIIKKPTMRLLQSLFYTENEELGAKMIELPYKEPGFRMVVVLPDKIDGLPAVLEKAAEKGLLEDVFNLSPAGRDIELEIPKFEIRSGLDLNTILPKVGVSKIFQEPAPAIVKNDQVVVSRAFQEAFVKVDEEGATAGAFTGLIAVPTSSLSRPPPSLLFKVDHPFLILHEEDKILLLGHTHIKNCICF

SEQ ID NO: 1767 - protein, 356 aa, Bacillus PS3
MNKGLCNWRLFSLFGMMALLLAGCGKPFLSTLQPAGEVADMQYSLMLLSTSIMVLVIVVVAIIFVYVVIRFRRRKGEENKIPKQVEGSHKLEIIWTVIPIILLLILAVPTVLTTFKLADVKAMNDKKRDKNTVVVNVRANQYWWEFEYPDYGIITSQDLVVPTNEKVYFNLIASDVKHSFWIPAVGGKMDTNTDNKNQFWLVFDQKATDKAGGVFYGKCAELCGPSHALMDFKVRPLPRDQFDAWVKKMQNAKKPVVTDPVAKEGEAIFNKSCIGCHAVTPLDKRPAQRRTAPNLADFGDRERIAGILEHNEENLKKWLRDPNSVKPGNKMAGTYGHLTEEQIDALTKYLMSLKVE

SEQ ID NO: 1768 - protein, 166 aa, Vibrio parahaemolyticus
MTKQQMIAMFIAMIITSALVSAATIMGGIWYLNKQAQDSGETSSLLENSPLSFLVTEQPTSKGPSFHPLDKVVLSIKGKKQTHFVMLELAIETRRPERIKDIDNYMPMVQNSLLKLFSDKTFDELQQTGAIDILQNEVKQTLLVAFAKTDIVRDIDDVLLTKYVVQ

SEQ ID NO: 1769 - protein, 285 aa, Leuconostoc mesenteroides
MAINFEQVNFSYGAGTTLAQPILHDINVTIPDGQVTAIIGQTGSGKSTFIQHLNGLLKPTTGRVVIDDFVLTSDLKEKNLTSLRARVGMVFQFPENQLFANTVLEDVMYAPINFGYAKADAEFAAKTALKQVNVSEELWDKSPFELSGGQMRRVAMAGTLASNPDIIVLDEPAAGLDPKGQKELLAIVRGLKEAGKLVVFISHQMDHVIAVADHVIVMHDGGVVAEGTPVEIFNKDLVWFKTVALDLPKAGQFAEQLRQKGHILRHRPLLLTELATMLNEEKRHE

SEQ ID NO: 1770 - protein, 272 aa, Leuconostoc mesenteroides
MVKAIKIDNLKYSYDERSLFSDFNLDIDAGQWVALVGHNGSGKSTLAKLILGLLVAEQGDIDVFDERLTVETVHHVRSKIGMVFQNPDNQFVGATVADDVAFGLENIQVESSEMPQKIDNALTIVGMQEFKNREPHTLSGGQKQRVALASVLALQPKIIILDEATAMLDPDGRATVMETLQKLKKQFGKELTLVTITHDMDEATLADRVVVINDGQKILDGTPAEVFSQRKALHENGLELPFANELAFHLNEKPNKYMDERELIQWLSTLNK

SEQ ID NO: 1771 - protein, 312 aa, Saccharomyces cerevisiae
MSIVETCISFVSTNPFYPFCTGLLLNCVVTPLYFWKTQNGRIVVVSLLQFVVLYATAFISIGTDKSLYRNKWVALPLSKKTRISRNTSLYCFKLKYPFERLHIPMGYHLAVRVTINGERLVRYYTPVNVPNTEGHLELVVKTYKHGVVSKYFDKLKIRQYVEFKGPLGELEYDQDTATELGIIAGGSGITPVLQVLQEIIPSPEDLTHISLIYANETEDDILMKSQLDHMAKEYPHFKVHYVIHKPNGKWNGDVGYVTLEEMKRYLPKQAEDHRLLICGPPKMNEMVLNYAKELGWSNGFHKGNGTDKVFVF

SEQ ID NO: 1772 - protein, 147 aa, Saccharomyces cerevisiae
VALMGVSLNLPVWKQYICLSLPFLGSSMILTLLSNLYHEYHEQRKSPISGSIVYCFGAVGGTVGISLGGYVFHKTLIKLMHEKVMPFSKQGYLKKDLLKIIKHATESSDWVHESAPKFVFQTLIECYLQACRNVFKLSTLFFTITVV

SEQ ID NO: 1773 - protein, 83 aa, Saccharomyces cerevisiae
AVGGTVGISLGGYVFHKTLIKLMHEKVMPFSKQGYLKKDLLKIIKHATESSDWVHESAPKFVFQTLIECYLQACRNVFKLSTL

SEQ ID NO: 1774 - protein, 369 aa, Saccharomyces cerevisiae
MLFPKRLIVWGVLLILSLSQFVLYLPATTCTNSKGLRLCAPQFTITVIGGSSTANEFIASVREFLRLISYLTIDMGWSNEFTDPSVYEDENLVDTFQPDKVFELNYFGFCKRSNKSKVYCTSNENYGMDVLEVLVRDVGIQLGNISTTRSNETKKFGDSLVLTYRLALTSIRDFLKHDKHTGNALSKALIGSPDPNVKGVSPTKNYLKGVNLAFILMMFNGMVFYFAVLEIIVGFLSICVVSAFGGALSVGKRHRLFPMLLKSSSSILVVIATLTILCNIVYLIALKTLEPEEVTDVGSDNAAVHTTGWELLKVNVGSGFIMGLARYAIQWVLLVLAFLAANHYKAKPKKSDKYTEDTSNSPSPDLMEK

SEQ ID NO: 1775 - protein, 194 aa, Saccharomyces cerevisiae
KHDKHTGNALSKALIGSPDPNVKGVSPTKNYLKGVNLAFILMMFNGMVFYFAVLEIIVGFLSICVVSAFGGALSVGKRHRLFPMLLKSSSSILVVIATLTILCNIVYLIALKTLEPEEVTDVGSDNAAVHTTGWELLKVNVGSGFIMGLARYAIQWVLLVLAFLAANHYKAKPKKSDKYTEDTSNSPSPDLMEK

SEQ ID NO: 1776 - protein, 132 aa, Saccharomyces cerevisiae
ICVVSAFGGALSVGKRHRLFPMLLKSSSSILVVIATLTILCNIVYLIALKTLEPEEVTDVGSDNAAVHTTGWELLKVNVGSGFIMGLARYAIQWVLLVLAFLAANHYKAKPKKSDKYTEDTSNSPSPDLMEK

SEQ ID NO: 1777 - protein, 403 aa, Candida tropicalis
MTLPPVYIVSTARTPIGSFQGSLSSLTYSDLGAHAVKAALAKVPQIKPQDVDEIVFGGVLQANVGQAPARQVALKAGLPDSIIASTINKVCASGMKAVIIGAQNIICGTSDIVVVGGAESMSNTPYYLPSARSGARYGDAVMVDGVQKDGLLDVYEEKLMGVAAEKCAKDHGFSREDQDNFAINSYKKAGKALSEGKFKSEIAPVTIKGFRGKPDTVIENDEEIGKFNEDRLKSARTVFQKENGTVTAPNASKLNDGGAALVLVSEAKLKQLGLKPLAKISGWGEAARTPFDFTIAPALAVPKAVKHAGLTVDRVDFFELNEAFSVVGLANAELVKIPLEKLNVYGGAVAMGHPLGCSGARIIVTLLSVLTQEGGRFGAAGVCNGGGGASAIVIEKIDSDAKL

SEQ ID NO: 1778 - protein, 290 aa, Bacillus subtilis
MNFGNVSTAMITPFDNKGNVDFQKLSTLIDYLLKNGTDSLVVAGTTGESPTLSTEEKIALFEYTVKEVNGRVPVIAGTGSNNTKDSIKLTKKAEEAGVDAVMLVTPYYNKPSQEGMYQHFKAIAAETSLPVMLYNVPGRTVASLAPETTIRLAADIPNVVAIKEASGDLEAITKIIAETPEDFYVYSGDDALTLPILSVGGRGVVSVASHIAGTDMQQMIKNYTNGQTANAALIHQKLLPIMKELFKAPNPAPVKTALQLRGLDVGSVRLPLVPLTEDERLSLSSTISEL

SEQ ID NO: 1779 - protein, 332 aa, Echinococcus granulosus
MPGPLRVLITGAAGQIAYNLSNMVANGNLFGKDQQIILHLLDIPEAKTVLDGVVMELQDCAFTVLAGIVPTHCLKEAFTDIDVALMVGAMPRKQGMERRDLLSSNVKIFKEQGEALDKYAKKTVKVLVVGNPANTNCLIMSKYAPSIPKENFTALTRLDHNRAIYQVAAKAGVPNTCVKNVCIWGNHSNKQFPDLSHAVVTKDGKQHPAKELINDEKWVKEVFIPCVQNRGAAVIGLRKLSRAASAAKAIVDQMRDWWFGTKEGEWVSMSVYSTGDHYGAPKDIYFSFPVTIKDGHYKVVDGLSMDEWSRSLFNLSADELVDEREVALASFK

SEQ ID NO: 1780 - protein, 151 aa, Oryctolagus cuniculus
ELLEFAAFSIPTLVIMEQFATAYQRTRNASEKTHYWLIVSCSIAYVAVVSLLIWVPVKVLLHKKRHLYKKIKGWRPVMMMCVVLTTLPSFIFSIAVTEVQKTINTTVDVLPDTLPDLPVSLVISSLIITDIIEKLRFHPIRGYQKSNEDKH

SEQ ID NO: 1781 - protein, 47 aa, Oryctolagus cuniculus
LLIWVPVKVLLHKKRHLYKKIKGWRPVMMMCVVLTTLPSFIFSIAVT

SEQ ID NO: 1782 - protein, 77 aa, Catharanthus roseus
VLQAFGKNKPEFERLNHLKYVSMILYEVLRLYPPVIDLTKIVHKDTKLGSYTIPAGTQVMLPTVMLHREKSIWGEDA

SEQ ID NO: 1783 - protein, 56 aa, Catharanthus roseus
LKYVSMILYEVLRLYPPVIDLTKIVHKDTKLGSYTIPAGTQVMLPTVMLHREKSIW

SEQ ID NO: 1784 - protein, 191 aa, Caenorhabditis elegans
MQTIKCVVVGDGAVGKTCLLISYTTNKFPSEYVPTVFDNYAVTVMIGGEPYTLGLFDTAGQEDYDRLRPLSYPQTDVFLVCFSVVAPASFENVREKWVPEISHHCSKTPFLLVGTQVDLRDDPGMLEKLAKNKQKPVSTDVGEKLAKELKAVKYVECSALTQKGLKNVFDEAILAALDPPQQEKKKKCNIL

SEQ ID NO: 1785 - protein, 441 aa, Mesembryanthemum crystallinum
MAVAELSPSYKTQLKTCQQLSSSLSTRLSDHRKFSLRLLPRPVSVRGGIRCSVAPNQVQAPVAVPAEGQTGKPECYGIFCLTYDLKAEEETKTWKKMITIAVSGAAGMISNHLLFKLASGEVFGPDQPIALKLLGSERSFNALEGVAMELEDSLYPLLRAVSIGIDPYDIFQDAEWALLIGAKPRGPGMERADLLDINGQIFAEQGKALNAVASRNVKVIVVGNPCNTNALICLKNAPNIPAKNFHGLTRLDENRAKCQLALKAGVFYDKVSNMTIWGNHSTTQVPDFLNAKIDGLPVKTVIKDHKWLEEEFTVMIQKRGGALIQKWGRSSAASTAVSIADAIKSLVTPTPEGDWFSSAVYTNGNPYGIAEDLVFSMPCRSKGDGDYELVKDVVFDDYLRQRIKKSEEELLAEKRCTAHLTGEGVAVCDLPAGDTMLPGEM

SEQ ID NO: 1786 - protein, 589 aa, Saccharomyces cerevisiae
MSGVSNKTVSINGWYGMPIHLLREEGDFAQFMILTINELKIAIHGYLRNTPWYNMLKDYLFVIFCYKLISNFFYLLKVYGPVRLAVRTYEHSSRRLFRWLLDSPFLRGTVEKEVTKVKQSIEDELIRSDSQLMNFPQLPSNGIPQDDVIEELNKLNDLIPHTQWKEGKVSGAVYHGGDDLIHLQTIAYEKYCVANQLHPDVFPAVRKMESEVVSMVLRMFNAPSDTGCGTTTSGGTESLLLACLSAKMYALHHRGITEPEIIAPVTAHAGFDKAAYYFGMKLRHVELDPTTYQVDLGKVKKFINKNTILLVGSAPNFPHGIADDIEGLGKIAQKYKLPLHVDSCLGSFIVSFMEKAGYKNLPLLDFRVPGVTSISCDTHKYGFAPKGSSVIMYRNSDLRMHQYYVNPAWTGGLYGSPTLAGSRPGAIVVGCWATMVNMGENGYIESCQEIVGAAMKFKKYIQENIPDLNIMGNPRYSVISFSSKTLNIHELSDRLSKKGWHFNALQKPVALHMAFTRLSAHVVDEICDILRTTVQELKSESNSKPSPDGTSALYGVAGSVKTAGVADKLIVGFLDALYKLGPGEDTATK

SEQ ID NO: 1787 - protein, 137 aa, Streptococcus mutans
MPMDLRDNKQSQKKWKNRTLTSSLEFALTGIFTAFKEERNMKKHAVSALLAVIAGLVFKVSVIEWLFLLLSIFLVITFEIVNSAIENVVDLASDYHFSMLAKNAKDMAAGAVLVISGFAALTGLIIFVPKIWFLLFH

SEQ ID NO: 1788 - protein, 448 aa, Arabidopsis thaliana
MPMFQPLKRDGLIGFEGGGDGQVLDLDTAVKDGVLGGVNGGGVGVVDEKLDLKKMIKELDLQDIPSVFICPISLEPMQDPVTLCTGQTYERLNIHKWFNLGHLTCPTTMQELWDDTVTPNKTLHHLIYTWFSQKYVLMKKRSEDVQGRAIEILGTLKKAKGQARVHALSELKQIVIAHLMARKTVVEEGGVSVISSLLGPFTSHAVGSEVVAILVSLDLDSDSKSGLMQPAKVSLIVDMLNDGSNETKINCARLIRGLVEEKGFRAELVSSHSLLVGLMRLVKDKRHRNGVSPALRLLKPISVHKQVRSLMVSIGAVPQLVDILPSLDPECLELALFVLDALCTDVEGRVAVKDSANTIPYTVRVLMRVSENCTNYALSILWSVCKLAPEECSPLAVEVGLAAKLLLVIQSGCDAALKQRSAELLKLCSLHYSDTMFISKCKLTRTIQ

SEQ ID NO: 1789 - protein, 574 aa, Bos taurus
MNPGAARTPALRILALGALLWPAARPWELTILHTNDVHSRLEQTSEDSSKCVNASRCVGGVARLATKVHQIRRAEPHVLLLDAGDQYQGTIWFTVYKGTEVAHFMNALGYDAMALGNHEFDNGVEGLIDPLLKEVNFPILSANIKAKGPLASKISGLYSPYKILTVGDEVVGIVGYTSKETPFLSNPGTNLVFEDEITALQPEVDKLKTLNVNKIIALGHSGFEVDKLIAQKVKGVDVVVGGHSNTFLYTGNPPSKEVPAGQYPFIVTSDDGRKVPVVQAYAFGKYLGYLKVEFDEKGNVVTSHGNPILLNSSIPEDPNIKADINKWRVKLDNYSTQELGKTIVYLDGTAQSCRFRECNMGNLICDAMINNNLRHPDEMSWNHVSMCILNGGGIRSPIDERNNGTITWENLAAVLPFGGTFDLVQLKGSTLKKAFEHSVHRYGQATGEFLQVGGIHVVYDISRNPGDRVVKLEVLCTQCRVPSYEPLRMDKVYKVILPSFLVSGGDGFQMIKDEKIKHDSGDQDINVVSGYISKMKVLYPAVEGRIQFSAGSHCCGSFSLIFLSVLAVIIILYQ

SEQ ID NO: 1790 - protein, 316 aa, Mus musculus
MNSVADTAIFFGKFLYYFLESLVFKVIPKRKKDVSGEIVLITGAGSGLGRLLAIHFASHGATLVLWDINQEGNMETCRLVKQKGDVKVFAYKCDCSSRIEVYRVADQVKEEVGDVTILINNAGVVTGKSFLNTPDHLVEKSFLVNAISHFWTCKAFLPAMVKANHGHLVCISSIAGLVGINGLSDYSSSKFAAFGFAESLFLELTMIMKTKVKSTIVCPYFIKTGMFEGCTTKYPLLLPLLEQEYVAQKIFNAILEEQVYLIIPKFAYVALFLKQIISPKMMIALGEYLGVDTCMTSFTGRVKAEELQMETKRKEQ

SEQ ID NO: 1791 - protein, 134 aa, Mus musculus
VKEEVGDVTILINNAGVVTGKSFLNTPDHLVEKSFLVNAISHFWTCKAFLPAMVKANHGHLVCISSIAGLVGINGLSDYSSSKFAAFGFAESLFLELTMIMKTKVKSTIVCPYFIKTGMFEGCTTKYPLLLPLL

SEQ ID NO: 1792 - protein, 193 aa, Mus musculus
LESLVFKVIPKRKKDVSGEIVLITGAGSGLGRLLAIHFASHGATLVLWDINQEGNMETCRLVKQKGDVKVFAYKCDCSSRIEVYRVADQVKEEVGDVTILINNAGVVTGKSFLNTPDHLVEKSFLVNAISHFWTCKAFLPAMVKANHGHLVCISSIAGLVGINGLSDYSSSKFAAFGFAESLFLELTMIMKTK

SEQ ID NO: 1793 - protein, 678 aa, Xenopus tropicalis
MAAHHRQNTAGRRKVQVSYVIRDEVEKYNRNGVNALQLDPALNRLFTAGRDSIIRIWNVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQMGTVIVSGSTEKVLRVWDPRTCQKLMKLKGHTDNVKALLLNRDGTQCLSGSSDGTIRLWSLGQQRCIATYRVHDEGVWALQVNEGFTHVYSGGRDRKIYCTDLRNPDIRLLICEEKAPVLKMELDRSADPPLALWVATTKSSVNKWPIKGILNFRSSGDYENDCSTPLSPICSQPDQVIKGGASIIQCNILNDKRHILTKDTNNNVAYWDVLKACKVEDLGKVDFEEEIKKRFKMVYVPNWFSVDLKTGMLTITLDESDCFAAWVSAKDAGFSSPDGSDPKLNLGGLLLQALLEFWPRTHINPMEEEENEVNHVANGEQENRIQKGNGYFQVPPHTPVIFGEAGGRTLFRLLCRDSGGETESMLLNETVPQWVIDITVDKNMPKFNKIPFYLQPHSSSGAKTLKKDRLSASDMLQVRKVMEHVYEKIINVDTESQTTSSSNNEKPGEQEKEEDIAVLAEEKIELLCQDQILDPNMDLRTVKHFIWKSGGDLTLHYRQKST

SEQ ID NO: 1794 - protein, 309 aa, Bos taurus
MVSDEDELNLLVIIVDTNPIWWGKQALKESQFTLSKCIDAVMVLGNSHLFMNRSNKLAVIASHIQESRFLYPGKNGRLGDFFGDPGNPSSEFTPSGSKDGKYELLTAANEVIAEEIKDLMTKSDIEGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKMSS

SEQ ID NO: 1795 - protein, 410 aa, Bacillus megaterium
MKEVIAVKEITRFKTRTEEFSPYAWCKRMLENDPVSYHEGTDTWNVFKYEDVKRVLSDYKHFSSVRKRTTISVGTDSEEGSVPEKIQITESDPPDHRKRRSLLAAAFTPRSLQNWEPRIQEIADELIGQMDGGTEIDIVASLASPLPIIVMADLMGVPSKDRLLFKKWVDTLFLPFDREKQEEVDKLKQVAAKEYYQYLYPIVVQKRLNPADDIISDLLKSEVDGEMFTDDEVVRTTMLILGAGVETTSHLLANSFYSLLYDDKEVYQELHENLDLVPQAVEEMLRFRFNLIKLDRTVKEDNDLLGVELKEGDSVVVWMSAANMDEEMFEDPFTLNIHRPNNKKHLTFGNGPHFCLGAPLARLEAKIALTAFLKKFKHIEAVPSFQLEENLTDSATGQTLTSLPLKASRM

SEQ ID NO: 1796 - protein, 71 aa, Trichoplusia ni
LCILKLLNHILQPTMYDDIREVAREWVIEENMDKYLKTDVVKKFIDTFKMGMLPRGEVFVHTNELHLEQAV

SEQ ID NO: 1797 - protein, 116 aa, Trichoplusia ni
LVLVASLGLRGSVVKDDTTVVIGKDNMVTMDIKMKELCILKLLNHILQPTMYDDIREVAREWVIEENMDKYLKTDVVKKFIDTFKMGMLPRGEVFVHTNELHLEQAVKVFKIMYSA

SEQ ID NO: 1798 - protein, 749 aa, Trichoplusia ni
MRAVLLFVVSLAALRMARPEIDDTTLVTMDIKQRQLVILKLLNHVVEPLMYKDLEELGKNFKIEENTDLFTKTDVLKDFIKMRKVGFLPRGEIFTLHVDRQLKEVVTMFHMLYYAKDFTTFVKTACWMRLYLNEGMFVYALTVAVRHREDCKGIILPPPYEIYPYYFVRADVIQKAYLLKMKKGLLDLKLCDFYGIKKTDKDVFIIDENVYDKRVHLNKEDKLRYFTEDIDLNTYYFYFHVDYPFWMKDKFMDKMKMRRFELTYIMYQQILARYILERLSNGMGMIKDLSWHKTIKKGYWPWMKLHNGVEIPVRFDNYVIVRDHNRDVIRLCDEYERIIRDAIIKGFIEINGMRLELTKTDDIETLGKLIFGKIDKVDLDKTLVDSYRYLLIVMKAALGLNTFHSDKYFVVPSILDQYQTALRDPVFYMLQKRIIDLVHLFKLRLPSYTKEDLYFPGVKIDNVVVDKLVTYFDDYLMDMTNAVYLTEDEIKKTKSDMVFMVRKRRLNHQPFKVTLDILSDKSVDCVVRVFLGPKKDNLNRLIDINRNRLNFVELDTFLYKLNTGKNTIVRNSYDMHNLVKDRMMTRDFMKKVESITDMRDLMIKDLRNYHTGFPTRLLLPKGFVGGMHMMLYVIVTPLRLVDNVDINILDINRKDLMRDFRSTVLLDKMPLGFPFDRRIDVGNFFTPNMKFVEVTIFHKRMTCDMKTRWNRWVLKDYDMVDRTRIESDSYFVDTDLDMKVNRNVNLIDV

SEQ ID NO: 1799 - protein, 141 aa, Trichoplusia ni
PEIDDTTLVTMDIKQRQLVILKLLNHVVEPLMYKDLEELGKNFKIEENTDLFTKTDVLKDFIKMRKVGFLPRGEIFTLHVDRQLKEVVTMFHMLYYAKDFTTFVKTACWMRLYLNEGMFVYALTVAVRHREDCKGIILPPP

SEQ ID NO: 1800 - protein, 572 aa, Saccharomyces cerevisiae
MVIILLGLCTLGFPRTAFCPSIMTNSTVSINTPPPYLTLACNEKLPTVMSIAGSDSSGGAGVEADIKTITAHRCYAMTCVTTLTAQTPVKVYGAQNIPKKMVSQILDANLQDMKCNVIKTGMLTVDAIEVLHEKLLQLGENRPKLVIDPVLCAASDSSPTGKDVVSLIIEKISPFADILTPNISDCFMLLGENREVSKLQDVLEIAKDLSRITNCSNILVKGGHIPCDDGKEKHITDVLYLGAEQKFITFKGQFVNTTRTHGAGCTLASAIASNLARGYSLSQSVYGGIEYVQNAIAIGCDVTKKAVKVGPINHVYAVEIPLEKMLTDECFTASDAVPKKPIEGSLDKIPGGSFFNYLINHPKVKPHWDAYVNHEFVKRVADGTLERKKFQFFIEQDYLYLIDYVRVCCVTGSKSPTLEDLEKDLVIADCARNELNEHERRLREEFGVKDPDYLQKIKRGPALRAYCRYLIDISRRGNWQEIVVALNPCLMGYVYAVDKVKDKITAAEGSIYSEWCDTCASSFCYQAVLEGERLMNHILETYPPDQLDSLVTIFARGCELETNFWTAAMEYE

SEQ ID NO: 1801 - protein, 159 aa, Saccharomyces cerevisiae
VKEYTKSKLPCSILNIKPTVTKSGEDAPLLVWIPGNPGLLYYYQEMLHHLHLKHPDWEILGISHAGMTLNAHSNTPIFSLQDQVDHQVEVINNFSCKNRKIIIMGHSVGAYIVQKVCLSNKLVGSVQKVGLVTPTVMDIHTSEMGIKMTAALRYIPPLA

SEQ ID NO: 1802 - protein, 132 aa, Saccharomyces cerevisiae
YTKSKLPCSILNIKPTVTKSGEDAPLLVWIPGNPGLLYYYQEMLHHLHLKHPDWEILGISHAGMTLNAHSNTPIFSLQDQVDHQVEVINNFSCKNRKIIIMGHSVGAYIVQKVCLSNKLVGSVQKVGLVTPT

SEQ ID NO: 1803 - protein, 197 aa, Saccharomyces cerevisiae
MKLLHLYEASLKRRPKTTNAIMTGALFGIGDVSAQLLFPTSKVNKGYDYKRTARAVIYGSLIFSFIGDKWYKILNNKIYMRNRPQYHWSNMVLRVAVDQLAFAPLGLPFYFTCMSIMEGRSFDVAKLKIKEQWWPTLLTNWAVWPLFQAINFSVVPLQHRLLAVNVVAIFWNTYLSYKNSKVMEKDKVPVHYPPVVE

SEQ ID NO: 1804 - protein, 93 aa, Saccharomyces cerevisiae
TLAWKLVLNKKDMRMNFFSNTNATHIPVEIAKDMLQDTLLTPIDLYDVHGPVIPMKALEIANALVDVVSKYDHNMKLEAWNILCDVSKFVFSL

SEQ ID NO: 1805 - protein, 92 aa, Saccharomyces cerevisiae
TNATHIPVEIAKDMLQDTLLTPIDLYDVHGPVIPMKALEIANALVDVVSKYDHNMKLEAWNILCDVSKFVFSLKHCNHKMFQRFSTKCQSAL

SEQ ID NO: 1806 - protein, 248 aa, Rattus norvegicus
MNLLLLLLTVSLAPTTEAAEIIGGHEADPHSRPYMAYLQYKNEDSRDTICGGFLIREDFVLTAAHCSGSKINVTLGAHNIKEQEKTQQVIPVVKIIPHPAYNAKTISNDIMLLKLKSKAKRTRAVKTLSLPRSNFKVKPGDVCYVAGWGKLGPMGKFPDKLQEVELTVQEDQECETYLKNAYDKANQICAGDPKIKCASFQGDSGGPLVCKKVAAGIVSYGRKDGSTPRAFTKVSTFLSWIEETMKKS

SEQ ID NO: 1807 - protein, 71 aa, Saccharomyces cerevisiae
TKYKIPVNLQLETKYLRDDALLIKCPSSLRVSEPSKVHLPLKNIGHIDKVKDDYLVVSSWSGMTIVYNMRT

SEQ ID NO: 1808 - protein, 76 aa, Saccharomyces cerevisiae
YKIPVNLQLETKYLRDDALLIKCPSSLRVSEPSKVHLPLKNIGHIDKVKDDYLVVSSWSGMTIVYNMRTSEVEQTF

SEQ ID NO: 1809 - protein, 464 aa, Lithobates catesbeiana
MYICLLTLVLIHAAAAFVAQNATGILAGKDHCVCEVLLPDSSFPAKRVGALEDETIRLSNRVEDEMQKLEEQDIILDTYSEKIINLTRRVEYLEKLHPESLVEISFEVLKREIRELEMYISAMRVKPNGNSVQVETLYNEVKNMSKTVGQLETLDKNNVLQAKREIVNLKKRLVDCEKNLKAKPSLMVPLGSCQHQGLAHISKPNLMQLNWKGNAYKSGAWGKDAAWNTTKKSLYWVAPLNTDGRVLESIRIYPSMSDLQMYKNPIDLPLSMLIKNKLNNTFAGQGAGVVVHNNNLYYNCFNSHDMCRASLTSGVYQKKPLLNALFNNRFSYAGTMFQDMDFSSDEKGLWVIFTTEKSAGKIVVGKVNVATFTVDNIWITTQNKSDASNAFMICGVLYVTRSLGPKMEEVFYMFDTKTGKEGHLSIMMEKMAEKVHSLSYNSNDRKLYMFSEGYLLHYDIALKP

SEQ ID NO: 1810 - protein, 150 aa, Mus musculus
LIPIDQFKPSDVEIQACFRHENIAELYGAVLWGDTVHLFMEAGEGGSVLEKLESCGPMREFEIIWVTKHILKGLDFLHSKKVIHHDIKPSNIVFMSTKAVLVDFGLSVKMTEDVYLPKDLRGTEIYMSPEVILCRGHSTKADIYSLGATL

SEQ ID NO: 1811 - protein, 93 aa, Mus musculus
LWGDTVHLFMEAGEGGSVLEKLESCGPMREFEIIWVTKHILKGLDFLHSKKVIHHDIKPSNIVFMSTKAVLVDFGLSVKMTEDVYLPKDLRGT

SEQ ID NO: 1812 - protein, 597 aa, Drosophila melanogaster
MALKVLVGQKLMNEVVKYKPPPPKKQGVTSAAGAGGMEWRVLVVDKLGMRMVSACTKMHEISAEGITLVEDINKKREPLPTMDAIYLITPSDESVRGLIRDFENPARPMYRYAHVFFTEVCPEELFNDLCKSCAAGKIKTLKEINIAFLPYECQVFSLDSPDTFQCLYSPAFASIRSKHIERIAEQIATLCATLGEYPNVRYRSDWDRNIDLAASVQQKLDAYKADDATMGEGPEKARSQLLILDRGFDCVSPLLHELTLQAMAYDLLPIVNDVYRYTPGPNQPDKEVLLDENDDLWVELRHEHIAVVSTQVTQNLKKFTDSKRMGSADKSSMRDLSQMIKKMPQYQKELSKYSTHLHLAEDCMKSYQNYVDKLCRVEQDLAMGTDAEGEKIKDHMRNIVPILLDANVSNYDKVRIIALYVMIKNGISEENLTKLFTHAQLSPKDQDMVRNLSCLGINVIADSRKKQYSVPRKERTTESTYQMSRWTPVIKDIMEDCIEDKLDLRHFPFLEGRAQNTNYHAPTSARYGHWHKDKGQAQVKNVPRLIVFIVGGVSMSEMRCAYEVTNAVRNWEVLVGSSHILSPEIFLSDLGSLSKED

SEQ ID NO: 1813 - protein, 446 aa, Moorella thermoacetica
MPLTGLEIYKQLPKKNCGECGTPTCLAFAMNLASGKASLDSCPYVSDAAREALDAAAAPPIAKVVLGAGPTAVEMGDETELFRHDKRFYHETAIAIQVSDNLSSEELKAKVEAINGLNFDRVGQHYTIQAIAIRHDADDPAAFKAAVASVAAATQLNLVLMADDPDVLKEALAGVADRKPLLYAATGANYEAMTALAKENNCPLAVYGNGLEELAELVDKIVALGHKQLVLDPGARETSRAIADFTQIRRLAIKKRFRSFGYPIIALTTAANPLDEVLQAVNYVTKYASLVVLRTDAKEHLLPLLSWRQNLYTDPQVPIRVEEKLNEIGAVNENSPVYVTTNFSLTYYSVEGEIESTKIPSYLLSVDTDGLSVLTAYADGKFEAEKIAAVMKKVDLDNKVKRHRIIIPGAVAVLKGKLEDLTGWEVIVGPREASGIVAFARANLAS

SEQ ID NO: 1814 - protein, 131 aa, Saccharomyces cerevisiae
LCDVLGVGLLTVQDIKVKNHPQFKNVAVTADRWMPMEEVALDEIASFMKEKKKEGYTLIGLEQTDKSVKLDNNFQFPKKSLILLGTEAFGIPGTLLSELDLCLEIQQFGVIRSMNIQTATAVIVHSYTVQH

SEQ ID NO: 1815 - protein, 127 aa, Saccharomyces cerevisiae
LGVGLLTVQDIKVKNHPQFKNVAVTADRWMPMEEVALDEIASFMKEKKKEGYTLIGLEQTDKSVKLDNNFQFPKKSLILLGTEAFGIPGTLLSELDLCLEIQQFGVIRSMNIQTATAVIVHSYTVQH

SEQ ID NO: 1816 - protein, 414 aa, Plasmodium falciparum
MDFVKELKSSQDYMNNELTYGAHNYDPIPVVLKRGKGVFVYDIEDRRYYDFLSAYSSVNQGHCHPDILNAMINQAKKLTICSRAFFSDSLGVCERYLTNLFGYDKVLMMNTGAEASETAYKLCRKWGYEVKKIPENSAKIIVCNNNFSGRTLGCVSASTDKKCKNNFGPFVPNFLKVPYDDLEALEKELQDPNVCAFIVEPVQGEAGVIVPSDSYFPGVASLCKKYNVLFVADEVQTGLGRTGKLLCTHHYGVKPDVILLGKALSGGHYPISAILANDDVMLVLKPGEHGSTYGGNPLAAAICVEALKVLINEKLCENADKLGAPFLQNLKEQLKDSKVVREVRGKGLLCAIEFKNDLVNVWDICLKFKENGLITRSVHDKTVRLTPPLCITKEQLDECTEIIVKTVKFFDDNL

SEQ ID NO: 1817 - protein, 97 aa, Entamoeba histolytica
MKAIVFVLIFAVAFAVTLRQGPIVCNLCTGLINTLENLLTTKGADKVKDYIDSLCNKASGFIATLCTKVLDFGVDKLIQLIEDKVDANAICAKIHAC

SEQ ID NO: 1818 - protein, 155 aa, Gallus gallus
KSSVFFNFAIKEQIRTHTLFTPLLIAFGVAAGLMCIIVMILVYIYLQKPKYEVQWKVVEEINGNNYVYIDPTQLPYDHKWEFPRNRLSFGKTLGAGAFGKVVEATAYGLFKSDAAMTVAVKMLKPSAHLTEREALMSELKVLSYLGNHINIVNLL

SEQ ID NO: 1819 - protein, 137 aa, Gallus gallus
VAAGLMCIIVMILVYIYLQKPKYEVQWKVVEEINGNNYVYIDPTQLPYDHKWEFPRNRLSFGKTLGAGAFGKVVEATAYGLFKSDAAMTVAVKMLKPSAHLTEREALMSELKVLSYLGNHINIVNLLGACTIGGPTL

SEQ ID NO: 1820 - protein, 363 aa, Saccharomyces cerevisiae
MFTRRFIPVVQSTKQNIGKYVRKDARFTLLTYNMLSPSYMWPQVYTYVAEPYKNWSYRHRLLEKELLNTFKADIMCLQEMTARDYEDYWHDSIGVDVNYGSKFISKTPPKYWKKPVKDMDGVSIFYNLAKFDFISSSGIYLNQLLNVFNQRELKYLYNKKVTLTDGASNVIGEDSLLDVLKGKNQVCLFVSLRHKETGTIFVVLNTHLYWKYDEVKLTQCMIIMRELSKIIKQLLPGDVKGQERVKILFTGDLNSTRDSLVVNFLQGQIVSHGDLNLINPMRPYLDRCVYDDIPKDYFVHTCYSGKLKGIFDYVWYHDSDFLLTKILTGNEVSDELLASNQLGLPNENHPSDHIPLLTEFKIL

SEQ ID NO: 1821 - protein, 80 aa, Saccharomyces cerevisiae
TDGASNVIGEDSLLDVLKGKNQVCLFVSLRHKETGTIFVVLNTHLYWKYDEVKLTQCMIIMRELSKIIKQLLPGDVKGQE

SEQ ID NO: 1822 - protein, 54 aa, Saccharomyces cerevisiae
LDVLKGKNQVCLFVSLRHKETGTIFVVLNTHLYWKYDEVKLTQCMIIMRELSKI

SEQ ID NO: 1823 - protein, 383 aa, Saccharomyces cerevisiae
MAASEIMNNLPMHSLDSSLRDLLNDDLFIESDESTKSVNDQRSEVFQECVNLFIKRDIKDCLEKMSEVGFIDITVFKSNPMILDLFVSACDIMPSFTKLGLTLQSEILNIFTLDTPQCIETRKIILGDLSKLLVINKFFRCCIKVIQFNLTDHTEQEEKTLELESIMSDFIFVYITKMRTTIDVVGLQELIEIFIFQVKVKLHHKKPSPNMYWALCKTLPKLSPTLKGLYLSKDVSIEDAILNSIDNKIQKDKAKSKGKQRGVKQKIHHFHEPMLHNSSEEQVKVEDAFNQRTSTDSRLQSTGTAPRKKNNDITVLAGSFWAVLKHHFTRSVLNKNGLLLTGLLLLLCLKKYKSLMAIFKHVPAAFHTVYPQIVGLLKLLASI

SEQ ID NO: 1824 - protein, 63 aa, Saccharomyces cerevisiae
VYITKMRTTIDVVGLQELIEIFIFQVKVKLHHKKPSPNMYWALCKTLPKLSPTLKGLYLSKDV

SEQ ID NO: 1825 - protein, 72 aa, Saccharomyces cerevisiae
VYITKMRTTIDVVGLQELIEIFIFQVKVKLHHKKPSPNMYWALCKTLPKLSPTLKGLYLSKDVSIEDAILNS

SEQ ID NO: 1826 - protein, 113 aa, Saccharomyces cerevisiae
KSVAKNMFGLRLHELAGSSVTKLVPSLADMISYINKTYPMLNITLPENKGLVLTEHFFRKIEAEMHHDKDSFYTSIGLDGCHKDGNLIKVDVQLRVLNTNAVLLWITHSRDVV

SEQ ID NO: 1827 - protein, 136 aa, Saccharomyces cerevisiae
KSVAKNMFGLRLHELAGSSVTKLVPSLADMISYINKTYPMLNITLPENKGLVLTEHFFRKIEAEMHHDKDSFYTSIGLDGCHKDGNLIKVDVQLRVLNTNAVLLWITHSRDVVIENYTTVPSQLPMLKENEIDVVG

SEQ ID NO: 1828 - protein, 271 aa, Saccharomyces cerevisiae
MSSRVCYHINGPFFIIKLIDPKHLNSLTFEDFVYIALLLHKANDIDSVLFTVLQSSGKYFSSGGKFSAVNKLNDGDVTSEVEKVSKLVSAISSPNIFVANAFAIHKKVLVCCLNGPAIGLSASLVALCDIVYSQNDSVFLLFPFSNLGFVAEVGTSVTLTQKLGINSANEHMIFSTPVLFKELIGTIITKNYQLTNTETFNEKVLQDIKQNLEGLYPKSVLGMKELLHSEMKQKLIKAQAMETNGTLPFWASGEPFKRFKQLQEGNRRHKL

SEQ ID NO: 1829 - protein, 176 aa, Saccharomyces cerevisiae
MGRDICTLDNVYANNLGMLTKLAHVTVPNLYQDAFFSALFAEDSLVAKNKKPSSKKDVHFTQMAYYSEIPVGGLVAKLVPKKQNELSLKGIQIEFLGVLPNYRHKSIGSKLLKFAEDKCSECHQHNVFVYLPAVDDLTKQWFIAHGFEQVGETVNNFIKGVNGDEQDAILLKKHIS

SEQ ID NO: 1830 - protein, 134 aa, Mus musculus
VLDIGKCKEGKPVYISLPHFLHASPDVSEPIEGLHPNEDEHRTYLDVEPITGFTLQFAKRLQVNILVKPARKIEALKNLKRPYIVPILWLNETGTIGDEKAEMFKTQVTGKIKLLGMVEMALLGIGVVMFVAFM

SEQ ID NO: 1831 - protein, 123 aa, Mus musculus
LHASPDVSEPIEGLHPNEDEHRTYLDVEPITGFTLQFAKRLQVNILVKPARKIEALKNLKRPYIVPILWLNETGTIGDEKAEMFKTQVTGKIKLLGMVEMALLGIGVVMFVAFMISYCACKSK

SEQ ID NO: 1832 - protein, 186 aa, Saccharomyces cerevisiae
VRLWKAKPGQYVFVSFLHHLYFWQSHPFTVLDSIIKDGELTIILKEKKGVTKLVKKYVCCNGGKASMRLAIEGPYGSSSPVNNYDNVLLLTGGTGLPGPIAHAIKLGKTSAATGKQFIKLVIAVRGFNVLEAYKPELMCLEDLNVQLHIYNTMEVPALTPNDSLEISQQDEKADGKGVVMATTLEQ

SEQ ID NO: 1833 - protein, 56 aa, Saccharomyces cerevisiae
VSFLHHLYFWQSHPFTVLDSIIKDGELTIILKEKKGVTKLVKKYVCCNGGKASMRL

SEQ ID NO: 1834 - protein, 321 aa, Saccharomyces cerevisiae [sequence omitted]

SEQ ID NO: 1835 - protein, 65 aa, Saccharomyces cerevisiae
VHFVSSWTSQFRLRLLPVLMKNDIKVYLWTVNKPIDFKYLCELPIHGAITDDPIKARKLCDGHTV

SEQ ID NO: 1836 - protein, 193 aa, Saccharomyces cerevisiae
VGHRAFKARYPENTLLAFEKAYAAGADVIETDLQMTSDGMVVVNHDSDTGRMWDKNLVIGESTWEEVKRLRCKEDGSLAMMTLKEILTWAVCHPGAKLMLDIKFTNEKIIMIKTFVIMLEVKNDLKFWQERITWGLWLLDWYDFGIETGVLKDFKVIVISLSLDIASQFVKRSLTLNDPHYKLFGISVHFVSS

SEQ ID NO: 1837 - protein, 87 aa, Saccharomyces cerevisiae
CALSLVGEPILYPHINKFIQLLHQKGITSFLVCNAQHPEALRNIVKVTQLYVSIDAPTKTELKKVDRPLYKDFWERMVECLEILKTV

SEQ ID NO: 1838 - protein, 105 aa, Saccharomyces cerevisiae
CALSLVGEPILYPHINKFIQLLHQKGITSFLVCNAQHPEALRNIVKVTQLYVSIDAPTKTELKKVDRPLYKDFWERMVECLEILKTVQNHQRTVFRLTLVKGFNM

SEQ ID NO: 1839 - protein, 551 aa, Saccharomyces cerevisiae
MTYSTVNINTPPPYLALASNEKLPTVLSIAGTDPSGGAGVEADVKTITAHRCYAMTCITALNAQTPVKVYSINNTPKEVVSQILDANLQDMKCDVIKTGMLTTAAIEVLHEKLLQLGENRPKLVVDPVLVATSGSSLAGKDIASLITEKIAPFADILTPNIPECFKLLGEDREISKLRDIFEVAKDLAKITKCSNILVKGGHIPWNDEEGKYITDVLYLGAEQRFITFKGNFVNTTHTHGTGCTLASAIASNLARGYSLPQSVYGGIEYVQNAVAIGCDVTKETVKDNGPINHVYAIEIPLEKMLSDECFTASDAVHKKPVKSSLNKIPGGSFYKYLINHPKVKPHWDSYVNHDFVRKVADGSLEPKKFQFFIEQDYLYLVNYARISCIAGSKSPCLEDLEKELVIVECVRNGLCQHERRLREEFGIKDPDYLQKIQRGPALRAYCRYFNDVSRRGNWQELVIALNPCLMGYVHALTKIKDEVTAAEGSVYREWCETYSSSWCHEAMLEGEKLLNHILETYPPEKLDTLVTIYAEVCELEANFWTAALEYE

SEQ ID NO: 1840 - protein, 419 aa, Xenopus laevis
MAGPMCLCGMMRLLTALFIPVLITSVGLCLIFVLLFICTRLWVQRKKKVEIGKDGKKKKVVAFFHPYCNAGGGGERVLWCALRSLQKRYKDAIYVIYTGDKDASEEQILNGAAARFNIKLSHPVRFIFLEKRGLVEASCYPRFTLLGQSLGSVVLGWEALTKCVPDIYIDSMGYAFTLPLFKYLGGCHVGCYVHYPTISMDMLSVVRSQHARFNNAAFISNNPVLSRLKLIYYYLFALFYGWVGSCSDVIMVNSTWTFSHILDLWKCSDRTSIVYPPCDVQTFLEIDINQHKENEEHSVVSIGQFRPEKDHPLQIRAFAALLEKKTAEQRAKLKLILIGGCRNDEDELRVSELKKLSSELGIPVEFKVNVPFEELKKHLSEATIGLHTMWNEHFGIGESLAILFCKHIIASINILLMDA

SEQ ID NO: 1841 - protein, 726 aa, Xenopus tropicalis
MELGKGKLLRSGLNALYQAIHPVHGLAWTDGRQVVLTALHHNNEEPKFGNSIVVGQFEHVHGLYWGPFLGNDTPALLAVQHKKHVTVWQLCYSSLDKNKLVVSQTCEIGDPFPVLPQGCTWHPSKDILVVLTKRDVSVLYAVRYENTSIKADVKSSGLIHCACWTKDGSRLVVAIGSALHSYIWDSKQKSLNACAFCPVFDIGGYICAIESTVDSQVAVSTELPLDRICALNAGIAFDVPASSEITISSQPGLLLMEEEFSMDVVQKSADSGSLTTDSLATSPATLDLTHIVNHSKADLNSLLNMKKKDYLTGSGQDSSHLILVNFEKKVTTTRRVSIPGILVPDILAFDPTAHIVAVASNTCSAVLVYSLTSSSVPNIQQILLEKNERPKGLCFLTDKMLLVLVGRQKTSDPAFLPSSSSDKYLIRLMVKEVMFDEDSSASSGGNTSVQASFDSSMSIQDKKKLVESLYKEGQSAHREILLPGGVAPPTYLRKKKLIEEIRSYDGDQSPTSSANEFDDKRSKLRVESLDTEPKNRSITLGLDMDKKPNSRPTSPKSECQKSSPPNFIKHGEMSPQQEILSISRNVERLCCNFAHLQQHLSELTDITRNGKRPLSASYLPCRQAPYVTVVCQDAYHPEGPAMKRSILLCDNKLRLGTIQELFGLSLIEMQLGPSLWIILTGDSEGFIPLTFLANQEITIRDARISTTHPPLSMDRNNSLQPSSSVT

SEQ ID NO: 1842 - protein, 256 aa, Bos taurus
MAEPSAATQSPSVSSSSSGAESSAPGGGSGSPGACPALGTKSCGSSCADSFVSSSSSQPVSLFSTSQVHDLIFWRDVKKTGFVFGTTLIMLLSLAAFSVISVVSYLILALLSVTISFRVYKSVIQAVQKSEEGHPFKAYLDVDITLSSEAFHNYVNAAMVHINRALKLIIRLFLVEDLVDSLKLAVFMWLMTYVGAVFNGITLLILAELLVFSIPIVYEKYKTQIDHYVGIARDQTKSIVEKIQAKLPGIAKKKAE

SEQ ID NO: 1843 - protein, 237 aa, Bos taurus
MAEPSAATQSPSVSSSSSGAESSAPGGGSGSPGACPALGTKSCGSSCAVHDLIFWRDVKKTGFVFGTTLIMLLSLAAFSVISVVSYLILALLSVTISFRVYKSVIQAVQKSEEGHPFKAYLDVDITLSSEAFHNYVNAAMVHINRALKLIIRLFLVEDLVDSLKLAVFMWLMTYVGAVFNGITLLILAELLVFSIPIVYEKYKTQIDHYVGIARDQTKSIVEKIQAKLPGIAKKKAE

SEQ ID NO: 1844 - protein, 951 aa, Bos taurus
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKESDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 1845 - protein, 228 aa, Bos taurus
MPGARDQGAARARWLGIGLLGLFLLPVSLSLEVSVGKATTIYAVNGTEILLPCTFSSCFGFENLHFWWSYNSSDTYKILIDGTVKNEKSDPKVKLKDDDRITLEGSTKEKMNNISISLKNLEFSDTGKYTCHVKNPKENDFQHQATIFLQVVDKLEEVDNTVTLIILGVVGGVIGLLIFILLVKKFIAFIIKKTQEKKKECLVSSSGNDNTENGLPGSKAEEKAPTKV

SEQ ID NO: 1846 - protein, 122 aa, Mus musculus
AGFVDKTCSRPVSNCASGPCQNGGTCLQHTQPEQHILKVSMKELNKSTPLLTEGQAICFTILGVLTSLVVLGTVAIVFLNKCETWVSNLRYNHTFRKKKNLLLQYNSGEELAVNIIFPEKID

SEQ ID NO: 1847 - protein, 64 aa, Mus musculus
HILKVSMKELNKSTPLLTEGQAICFTILGVLTSLVVLGTVAIVFLNKCETWVSNLRYNHTFRKK

SEQ ID NO: 1848 - protein, 1100 aa, Caenorhabditis elegans
MESGDHLGNLFDDMVEEDNDEDSFEEPACEDSFDSQEASSKANEPQNDSFDEPIQSSVSKQSDDANGEDEINEEVIQEQKELDLNEEDFNLLTIEEVPLDVLTARIRRVFTEVTYRAEPAAIALFDVAHKIIFKSTMLDCKRNTVIDSIIEGLISIIVDERERDQGAEEAEHVLMIFIAKLAIKNKSMKCSDLLYKLILLVDRLYLHADSFVRCRIYRLIACLMEEANRYADVMREHGDDAFLSDEDPTESEVMIPSGVKNRWMGKLAKSLLDKSPEVRCKAVIALSLWDHDIECKTTCCDEVTVNDLLWKSVHDVDESVRVNAARRVHIANENDIDKCIDYVETSKDNRVKQAIIVRLASDVSLLSFSEKQRFRLVNLLNNSDSARVQDVIHQLLVESWMKVAGDEIISPSIFPFPDSDNNNIPKEFPSIILEYLDPLVDPTAVYVFMKFATVRFIQKSTVQQACGSLDVEKFMKDLLSMTIPDCERVGLMRRTTFRLIPKDNNDGNEDIRKIFSRIFISRCFVDVIFNFAKGRLDATHLRSRALTFFLPDVTTFVEHLEKFCDAYFHRNMSTDYTCKDLVLYNLLHLMNVATKYGDLHDDKMLYKHALKKILGNSSFVFSNDVKQLCDWMCDTAKQLMLSHEEVLNLEEAMKNDKVLEQMYLRSATMLLATCKHEEVESPTASMSSLFKTIIPALLGNKNEELQQLGLELIGFATSIDFENCEPYLKLTTLLIQRGDEVLTSTGVNTLIKVIKSQGFPKTANAIFQGEEQTEDDCQDALAKVFEKALVSLQGMALVQSVQDCLSMLSYGRYAWSKLMCAIIMLVFQKSNECLPLVKIFASYCKKSIRSDFNKMNLLLGFCRAVGIISKTGEDDSNIKLLEMTELVCECISSVHTIDGDEVIPQKKRKTDNEEELYPEIVLANRMVGRANSHPSSWIIRHVFTAMATSLRLECVPMKIVDTLHELLVDTYTVVRFNSNKTTQIAFKRFLTHCEKVITLHERMNALKLGVDFKKVKKEVICADEDPKSVSSSSSLGRKRGRKRENSEEEEKIDADDSFELFQYVPKSTRTRIRPTVNVEEDQNIKTEIEDSDDLEDSFEL

SEQ ID NO: 1849 - protein, 1097 aa, Caenorhabditis elegans
MESGDHLGNLFDDMVEEDNDEDSFEEPACEDSFDSQEASSKANEPQNDSFDEPIQSSVSKQSDDANGEDEINEEVIQEQKELDLNEEDFNLLTIEEVPLDVLTARIRRVFTEVTYRAEPAAIALFDVAHKIIFKSTMLDCKRNTVIDSIIEGLISIIVDERERDQGAEEAEHVLMIFIAKLAIKNKSMKCSDLLYKLILLVDRLYLHADSFVRCRIYRLIACLMEEANRYADVMREHGDDAFLSDEDPTESEVMIPSGVKNRWMGKLAKSLLDKSPEVRCKAVIALSLWDHDIECKTTCCDEVTVNDLLWKSVHDVDESVRVNAARRVHIANENDIDKCIDYVETSKDNRVKQAIIVRLASDVSLLSFSEKQRFRLVNLLNNSDSARVQDVIHQLLVESWMKVAGDEIISPSIFPFPDSDNNNIPKEFPSIILEYLDPLVDPTAVYVFMKFATVRFIQKSTVQQACGSLDVEKFMKDLLSMTIPDCERVGLMRRTTFRLIPKDNNDGNEDIRKIFSRIFISRCFVDVIFNFAKGRLDATHLRSRALTFFLPDVTTFVEHLEKFCDAYFHRNMSTDYTCKDLVLYNLLHLMNVATKYGDLHDDKMLYKHALKKILGNSSFVFSNDVKQLCDWMCDTAKQLMLSHEEVLNLEEAMKNDKVLEQMYLRSATMLLATCKHEEVESPTASMSSLFKTIIPALLGNKNEELQQLGLELIGFATSIDFENCEPYLKLTTLLIQRGDEVLTSTGVNTLIKVIKSQGFPKTANAIFQGEEQTEDDCQDALAKVFEKALVSLQGMALVQSVQDCLSMLSYGRYAWSKLMCAIIMLVFQKSNECLPLVKIFASYCKKSIRSDFNKMNLLLGFCRAVGIISKTGEDDSNIKLLEMTELVCECISSVHTIDGDEVIPQKKRKTDNEEELYPEIVLANRMVGRANSHPSSWIIRHVFTAMATSLRLECVPMKIVDTLHELLVDTYTVVRFNSNKTTQIAFKRFLTHCEKVITLHERMNALKLGVDFKKVKKEVICADEDPKSVSSSSSLGRKRGRKRENSEEEEKIDADDSFEYVPKSTRTRIRPTVNVEEDQNIKTEIEDSDDLEDSFEL

SEQ ID NO: 1850 - protein, 162 aa, Caenorhabditis elegans
MRYFNCLLYWFLSIFIVVVYYNEILTTPIIEPSVEYVLCSTLLDYLKAPIPVLLIDFEILEQIERNSCHMQTEKRVKIGVDKTQENAHLLQKDSRFHVVNYKNSTKTDHLDFEVTTFTKKSIPKRFGARIVGNVQVPLDIQQFMGFWQRSMVLDCKKERNEV

SEQ ID NO: 1851 - protein, 65 aa, Caenorhabditis elegans
KFLTLLAFRIFVKLNVQVMILEVGIGGEYDCTNVVEKPKVCGVTTLDYDHMSILGNKLSEIAWHK

SEQ ID NO: 1852 - protein, 73 aa, Caenorhabditis elegans
LTLLAFRIFVKLNVQVMILEVGIGGEYDCTNVVEKPKVCGVTTLDYDHMSILGNKLSEIAWHKAGIFKESVPA

SEQ ID NO: 1853 - protein, 65 aa, Caenorhabditis elegans; identical to SEQ ID NO: 1851

SEQ ID NO: 1854 - protein, 73 aa, Caenorhabditis elegans; identical to SEQ ID NO: 1852

SEQ ID NO: 1855 - protein, 484 aa, Caenorhabditis elegans
MSSEKAVPCYEESVRLLNGLQSNAATIKKLRVQRENLQAINLPQCRKYLESLNISAEDLNALNIIHVSGTKGKGSACAFVESILRSQGLRTGFYSSPHLVHVRERIQVDGQPVSEQMFAEEFFHVYDIIKREHSDNMPAYFKFLTLLAFRIFVKLNVQVMILEVGIGGEYDCTNVVEKPKVCGVTTLDYDHMSILGNKLSEIAWHKAGIFKESVPAFYSPTTTEAEEVLIARAISKHVPLFQTPPVSAYQFARDISPGIRGAHQFSNVSMALQLVRAWAEKCGFPLPGVPLSTDTSGFNVPLWMCDAIESCRWPGRSQIVSTDRNVTYLLDGAHTPKSMEACSEWAAEEIVNLKKENVKKILLFQCTADRCPSTLIKYLKPLGISQIVSCPTQLHSSIDKSADSANLNASRDEQAEKANQCVQAWKESLDQPESVTEDQMKVFDCISSAYKFIESQAASQEILVLVTGSLHLVGGVLNLAGKGK

SEQ ID NO: 1856 - protein, 65 aa, Caenorhabditis elegans; identical to SEQ ID NO: 1851

SEQ ID NO: 1857 - protein, 73 aa, Caenorhabditis elegans; identical to SEQ ID NO: 1852

SEQ ID NO: 1858 - protein, 116 aa, Caenorhabditis elegans
PMVRRAAAAKLGEFAKVFEKTAVIEGLHSSLTDLHVDEQDSVRLLTVESAIAFGTLLDKANKKKLIEPILIELFDDKSWRVRYMVAEKLIEIQNVLGEDMDTTHLVNMYTNLLKDP

SEQ ID NO: 1859 - protein, 108 aa, Caenorhabditis elegans
MVRRAAAAKLGEFAKVFEKTAVIEGLHSSLTDLHVDEQDSVRLLTVESAIAFGTLLDKANKKKLIEPILIELFDDKSWRVRYMVAEKLIEIQNVLGEDMDTTHLVNMY

SEQ ID NO: 1860 - protein, 518 aa, Schizosaccharomyces pombe
MTKNKKYSYGTAGFRTKASDLEAAVYSSGVAAALRSMELKGKTIGVMITASHNPVEDNGVKIIDADGGMLAMEWEDKCTQLANAPSKAEFDFLIKQFLTPTTCQPKVIIGYDTRPSSPRLAELLKVCLDEMSASYIDYGYITTPQLHWLVRLINKSTAASFLEEGPPITEYYDTLTSAFSKIDPSMQDSPTVSRVVVDCANGVGSQPLKTVAGLVKDSLSIELVNTDVRASELLNNGCGADFVKTKQSPPLALEGKIKPNQLYASIDGDADRLIFYYINQNRKFHLLDGDKISTALVGYLNILVKKSGMPFSLGVVQTAYANGASTEYLQDLGITTVFTPTGVKHLHKAAKEFDIGVYFEANGHGTVLFSDKALANLAHPFFTPSPVQAAAIEQLQSYSVLINQAIGDAISDLLATISVLNALHWDASAWSNTYKDLPNKLAKVKVSDRTIYKSTDAERRLVSPDGLQEKIDALVAKYEKGRSFVRASGTEDVVRVYAEASTKQAADELCEKVCQLVL

SEQ ID NO: 1861 - protein, 513 aa, Schizosaccharomyces pombe
MKGLGLSTRTFNWSSLSSILLPRIPLATTKADSLILAVRHDKQVFSEDYRQVVDQYFETSPKKNDIRLFWNTQGFVRLAIVQLEENVSEKSVRSAAAEAAKILKSNGAKSIAVDGMGFPKDAALGAALATYDFSLRRDHLSVYQDEKVVEKENLFTSPAPERLTFQLLSNTSEKKTATAEENAFKVGLIEAAAQNLARSLMECPANYMTSLQFCHFAQELFQNSSKVKVFVHDEKWIDEQKMNGLLTVNAGSDIPPRFLEVQYIGKEKSKDDGWLGLVGKGVTFDSGGISIKPSQNMKEMRADMGGAAVMLSSIYALEQLSIPVNAVFVTPLTENLPSGSAAKPGDVIFMRNGLSVEIDNTDAEGRLILADAVHYVSSQYKTKAVIEASTLTGAMLVALGNVFTGAFVQGEELWKNLETASHDAGDLFWRMPFHEAYLKQLTSSSNADLCNVSRAGGGCCTAAAFIKCFLAQKDLSFAHLDIAGVMDKQLNSWDCDGMSGRPVRTIIEVARKY

SEQ ID NO: 1862 - protein, 68 aa, Schizosaccharomyces pombe
EDIVWSNLDLSMYTRRGKKTISNTILTLMIIFWAFPVAVVGCISNVNYLIEKVHFLKFIDHMPPKLLG

SEQ ID NO: 1863 - protein, 74 aa, Schizosaccharomyces pombe
KKTISNTILTLMIIFWAFPVAVVGCISNVNYLIEKVHFLKFIDHMPPKLLGIITGILPSVALSILMSLVPPFIK

SEQ ID NO: 1864 - protein, 542 aa, Schizosaccharomyces pombe
MSDAEDSDSIVNEFVTAIVRESDKFAKVHSYPMQYGTGGYRADAELLSSVAFRTGVIASFLSAKLHGQPVGLMVTASHNASSENGLKIVNILSSLDSSKWEAYLDQVVNADSADELTVCLTSILKKAKIIPGSEARVFVGYDSRSTSEILAQAVIDGIVVCKAKYENFGLLTTPQLHYMVKASQTYGTPDAIGEPTERGYFEKLSKAYQSLMTGKKIKGTVLIDAANGVGAAKIKELAKYIDPKLFPIEIVNDNIDNPELLNNSCGADFVRTQQKPPNGISAPKHARCASFDGDADRIVYFAFGSHSFHLLDGDKICALFAQFLIDLIRSTGLDLQVGIVQTAYANGASTAFFQKTLKVPVLCVSPGLKHLYHAAQAYDVGVFFEANGHGTILVSHAALSKIISHEVLSPAQFNALKTLKTVFELINQTDGDAITNLLLVEVILAHKNCTLKEWNQLYSEIPSRLIRCEVEDRSIYTTTDAEQKLVTPEGLQEKIDALVAKYTGGRAFVRSSGTEDAVRVYAEASSRGESEDLALRIVELLH

SEQ ID NO: 1865 - protein, 925 aa, Schizosaccharomyces pombe
MSLGLQPNNDISSLVSSKNMTSENGLEHQFEELLVEKQYSEEHCAYCHIKNPNSILKCLHCNKWFCNVRGKSGASHIISHLVRARHKQVALHSHSSLSDTVLECYNCGTRNVFLLGFIPAKAKTVVVLLCRQPCARASIAKDMNWDLTQWQPIISDRQFLPWLITPPSEEEQKLAIPITSQQMVRLEELWRKDPNANLEDLDKPIEDDSLPSVELRYKDAHAYQAVLSPLIQAEADYDKRLKESQTQKDVVVRWDQAINKRYTAWFLLPKLESGEIRLAIGDEMKLTYEGELRAPWSSTGYVIKIPNNVSDEVGLELKRSDKVPIECTHNFSVDYVWKSTSFDRMQTALRLFATDGSRLSSFLYHKLLGHDIPPSFLKPKLPSDLSVPNLPKLNASQSEAVRAVLSKPLSLIQGPPGTGKTVTSASVVYHLATMQSRKRKSHSPVLVCAPSNVAVDQLAEKIHRTGLRVVRVAAKSREDIESSVSFLSLHEQIKNYKFNPELQRLLKLRSENNELSIQDEKKLRILVAAAEKELLRAAHVICCTCVGAGDRRISKYKFRSVLIDEATQASEPECMIPLVLGAKQVVLVGDHQQLGPVVMNKKVALASLSQSLFERLIILGNSPFRLVVQYRMHPCLSEFPSNTFYEGTLQNGVTTSERIARHVDFPWIQPDSPLMFYANFGQEELSASGTSFLNRTEASTCEKIVTTFLRSNVLPEQIGIVTPYDGQRSYIVQYMQNNGSMQKDLYKAVEVASVDAFQGREKDFIILSCVRSSEHQGIGFVNDPRRLNVALTRAKYGVIVLGNPKVLAKHALWYHFVLHCKEKGYLVEGTLNSLQKFSLTLTPPQKPQKFKRDLNVQRSLSPIQNAGSAMLPSFSNLPNLYSSSYLEEWNVFAQYKRRESNATDFEDFRSQVGDDESKFDEPTRF

SEQ ID NO: 1866 - protein, 137 aa, Schizosaccharomyces pombe
LMHSVSVSDIWPLKVNYETSIPSKVYAIGSEIPVNITLYPLLKGLDVGKVTLVLKEYCTLFITSKAYSSTCRKEFKRALVKKTIPGLPMVDDYWQDQIMVKIPDSLGECTQDCDLNCIRVHHKLRLSISLLNPDGHV

SEQ ID NO: 1867 - protein, 115 aa, Schizosaccharomyces pombe
VYAIGSEIPVNITLYPLLKGLDVGKVTLVLKEYCTLFITSKAYSSTCRKEFKRALVKKTIPGLPMVDDYWQDQIMVKIPDSLGECTQDCDLNCIRVHHKLRLSISLLNPDGHVSE

SEQ ID NO: 1868 - protein, 231 aa, Schizosaccharomyces pombe
MASSSSSSGSSSPASKRSSRKRQTPPMPELPSFLLAFPHAPPLGFLRPKLNSLVVQVKRQGITAEPVFNLYSRFSVHTLSHNLVLDNVSSESNKTSAVFCKRHVGSSQVVIKIYSPHIKDYLPWTISCTKNEWVFDMLASFSIENSLRIKWVAPDKAKLNETWKCYLHIQDVKKSYFLASLTSRSLQFEGGSVGLSNRIITHRELEMVILSTSLCVQLSLLNLLPNYFPKP

SEQ ID NO: 1869 - protein, 138 aa, Schizosaccharomyces pombe
LVLDNVSSESNKTSAVFCKRHVGSSQVVIKIYSPHIKDYLPWTISCTKNEWVFDMLASFSIENSLRIKWVAPDKAKLNETWKCYLHIQDVKKSYFLASLTSRSLQFEGGSVGLSNRIITHRELEMVILSTSLCVQLSL

SEQ ID NO: 1870 - protein, 148 aa, Schizosaccharomyces pombe
LVLDNVSSESNKTSAVFCKRHVGSSQVVIKIYSPHIKDYLPWTISCTKNEWVFDMLASFSIENSLRIKWVAPDKAKLNETWKCYLHIQDVKKSYFLASLTSRSLQFEGGSVGLSNRIITHRELEMVILSTSLCVQLSLLNLLPNYFPK

SEQ ID NO: 1871 - protein, 202 aa, Schizosaccharomyces pombe
MATELRRKLVIVGDGACGKTCLLIVFSKGTFPEVYVPTVFENYVADVEVDGRHVELALWDTAGQEDYDRLRPLSYPDSHVILICFAVDSPDSLDNVQEKWISEVLHFCSSLPILLVACKADLRNDPKIIEELSKTNQHPVTTEEGQAVAQKIGAYKYLECSAKTNEGVREVFESATRAAMLKHKPKVKPSSGTKKKKRCILL

SEQ ID NO: 1872 - protein, 518 aa, Oryza sativa
MGVTKAEAVAGDGGKVVDDIEALADLRKEPAWKRFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 1873 - protein, 120 aa, Bos taurus
VIKDHSVKLHRVSPLLLQCRITHSSRWIAQVLASELSLLAFILLVVMVFSKKWLCFERIRFYQHWTMNVTTKIYTSVHIMSLGLLHIYKSKSYSNSEWESFKLWTNHPAFGVAKITFCLA

SEQ ID NO: 1874 - protein, 53 aa, Bos taurus
LAFILLVVMVFSKKWLCFERIRFYQHWTMNVTTKIYTSVHIMSLGLLHIYKSK

SEQ ID NO: 1875 - protein, 305 aa, Bos taurus
MDNTELIEYFKSQIKEDPDMASAVAAIRTLLEYLRRDTGETIQGLRANLTSAIETLCGVDSSVAVSSGGELFLRFISLTSLEYSDYSKCKKIMIERGEIFLRRISLSRNKIADLCHTFIKDGARILTHAYSRVVLRVLEAAVAAKKRFSVYITESQPDLSGKKMAKALCHLNVPVTVVLDAAVGYIMEKVDLVIVGAEGVVENGGIINKIGTNQMAVCAKAQNKPFYVVAESFKFVRLFPLNQQDVPDKFKYKADTLKSVQTGQDLREEHPWVDYTSPSLITLLFTDLGVLTPSAVSDELIKLYL

SEQ ID NO: 1876 - protein, 410 aa, Oryza sativa
MTARLALLASLLLLLQLVPPSSAVVLELHGNVYPIGHFFITMNIGDPAKSYFLDIDTGSTLTWLQCDAPCTNCNIVPHVLYKPTPKKLVTCADSLCTDLYTDLGKPKRCGSQKQCDYVIQYVDSSSMGVLVIDRFSLSASNGTNPTTIAFGCGYDQGKKNRNVPIPVDSILGLSRGKVTLLSQLKSQGVITKHVLGHCISSKGGGFLFFGDAQVPTSGVTWTPMNREHKYYSPGHGTLHFDSNSKAISAAPMAVIFDSGATYTYFAAQPYQATLSVVKSTLNSECKFLTEVTEKDRALTVCWKGKDKIVTIDEVKKCFRSLSLEFADGDKKATLEIPPEHYLIISQEGHVCLGILDGSKEHLSLAGTNLIGGITMLDQMVIYDSERSLLGWVNYQCDRIPRSESAITSRL

SEQ ID NO: 1877 - protein, 110 aa, Oryza sativa
VKKSPLPIAMDAIYYAGTGNLLCKAEDRVTIFDLQQRLILGELQAPAVKYVVWSSDMESIALLSKHAVVIANKKLVHRCTLHETIRVKSGAWDENGVFIYTTLNHIKYCL

SEQ ID NO: 1878 - protein, 83 aa, Oryza sativa
KKSPLPIAMDAIYYAGTGNLLCKAEDRVTIFDLQQRLILGELQAPAVKYVVWSSDMESIALLSKHAVVIANKKLVHRCTLHET

SEQ ID NO: 1879 - protein, 326 aa, Oryza sativa
MAALHHQAAAAPVTTTTDGGELRAMDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEVQQLLHIFKLLGTPNEQVWPGVSKLPNWHEYPQWNPSKVSDLVHGLDADALDLLEKMLQYEPSKRISAKKAMEHPYFNDVNKELY

SEQ ID NO: 1880 - protein, 329 aa, Sus scrofa
MATGQKLMSAIRVFKFGGPEVMKLQSDVAIPIPKDNQVLIKVHACGVNPVDTYIRSGTHNMKPLLPYTPGLDVAGIVEAVGEHVSSFKKGDRVFTVSTLSGGYAEYALAADDTVYMLPEKLDFKQGAAIGIPYFTACLALLHSACVKAGEIVLIHGASGGVGIAACQIARAYGLKVLGTAGTEEGQNIVLQNGAHEVFNHREVNYIDKIKKSVGEKGIDVIIEMLANVNLSNDLNLLSHGGRVIIVGSRGPIEINPRDTMTKGSSIKGVALYSSTKEEFQQLAAALQAGMEVGWLRPVIGPVYPLEKAAQAHEDIIHSRGATGKMILLL

SEQ ID NO: 1881 - protein, 309 aa, Danio rerio
MDILTAPVLIGVSIVVITVLYLFLKPAGSNSTPPKPQNKIPKALQDPSVKYPLPLIEKEEINHDTKRFRFGLPSSSHVLGLPIGQHIYLSAKVNGSLVVRAYTPVSSDQDQGYVDLVVKVYYKNTHPSYPDGGKMSQYLDNMKIGDTIDFRGPNGLLVYNGKGKFAIRPDKKSEAEVRKFKHVAMIAGGTGITPMLQLIRSITADSFDETVCSLIFANQTEKDILLRNELDEVHRNHPSKLKLWYTLDRPSEGWKYSEGFVNAAMMKDHLPPADSDVLVVMCGPPAMIEKACLPNLLKLGYKKENIFAY

SEQ ID NO: 1882 - protein, 104 aa, Bos taurus
QVTILTCRHVTDYKTSESTSSLHTPFLKALKTQNFKEPPFCSLLEQPNIVHDLPAAVLSYCQVWRIPAVLYLCYTDVMKLDLITIEAFKPVLSSKSLKCLVKNI

SEQ ID NO: 1883 - protein, 103 aa, Bos taurus
VTILTCRHVTDYKTSESTSSLHTPFLKALKTQNFKEPPFCSLLEQPNIVHDLPAAVLSYCQVWRIPAVLYLCYTDVMKLDLITIEAFKPVLSSKSLKCLVKNI

SEQ ID NO: 1884 - protein, 455 aa, Bos taurus
MFLAWERLCTLSCRPKFLKTVWASKILGLSTSAKMSLRFKNAKRIEGLDSNIWIEFTKLAADPSVVNLGQGLPDISPPVYVKEELSKIAAIDNLNQYTRGFGHPSLVKALSCLYEKFYHNKINPNEEILVTVGAYGSLFNAIQGLIDEGDEVIVIVPFFDCYESMVRMAGATPVFVPLRCKPVDGKKCSSSDWTLDPQELASKFNSKTKAIILNTPHNPLGKVYTKEELQVIADLCIKYDTLCISDEVYEWLVYTGNKHFKIATFPGMWERTITIGSAGKTFSVTGWKLGWSIGPKHLIKHLQTVQQNTVYTCATPLQEALAQAFWIDIKRMDDPECYFNSLPKELEVKRDRMVHLLESVGLKSIVPDGGYFIIADVSLLDVDLLDMKDSNEPYDYKFVKWMIKNKKLSAIPVSAFCNAETKSQFEKFVRFCFIKKDSTLDAAEEIIKAWSRQNS

SEQ ID NO: 1885 - protein, 37 aa, Bos taurus
HNPLGKVYTKEELQVIADLCIKYDTLCISDEVYEWLV

SEQ ID NO: 1886 - protein, 105 aa, Bos taurus
AGKTFSVTGWKLGWSIGPKHLIKHLQTVQQNTVYTCATPLQEALAQAFWIDIKRMDDPECYFNSLPKELEVKRDRMVHLLESVGLKSIVPDGGYFIIADVSLLDV

SEQ ID NO: 1887 - protein, 282 aa, Campylobacter jejuni
MTLLDGKALSAKIKEELKEKNQFLKSKGIESCLAVILVGDNPASQTYVKSKAKACEECGIKSLVYHLNENITQNELLALINTLNHDDSVHGILVQLPLPDHICKDLILESIISSKDVDGFHPINVGYLNLGLESGFLPCTPLGVMKLLKAYEIDLEGKDAVIIGASNIVGRPMATMLLNAGATVSVCHIKTKDLSLYTRQADLIIVAAGCVNLLRSDMVKEGVIVVDVGINRLESGKIVGDVDFEEVSKKSSYITPVPGGVGPMTIAMLLENTVKSAKNRLN

SEQ ID NO: 1888 - protein, 315 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 1889 - protein, 635 aa, Xenopus laevis
MMLAEQLSPEIQSSITIEYLNSSGQALKRKVIRNSFISLGRNEFRDLVLKVSDGKLQQNFVIKQIQLFTRFIRDGKASVVLLPENIQLLISNCPADKLKHFMKTLLIKHEAGKKEKPVNERTRLLSGLPRMFETISPVQKKDVEQANEMRAKANSETPVKGKGLSHKGVNGGNRCQQKRTRTESSNSLIADLRPSKKPTLSMPKQIRLSTEQSLVLNTVLSGRNVFFTGSAGTGKSYLLKRIVGALPPKSTYATASTGVAACHIGGTTLHAFAGIGSGKASLEQCIELAKRPGVRQHWTSCKHLIIDEISMVEGEFFDKLEAVARAVRGKDEPFGGIQLIVCGDFLQLPPVTQASSQTKFCFQGKSWRKCIHLTMELTEVRRQTDKNFISLLQAIRLGRCTDDVARQLLQTTNHKVERDGILATRLCTHKDDVEITNERRLQQLPGESHSYEALDSDPMLVKTINAQCPVNQQIQLKKGAQVMLAKNLDVSRGLVNGARGVVIKFEEGNKNLPVVRFLCGVTEVIKPDRWVFKGHGGIYLSRQQLPLKLAWAISIHKSQGMSLDCVEISLSRVFESGQAYVALSRARNLEGLRVMDFDPKVVRANPYVLQFYHQMQKERALRQTSLDDFLDKENC

SEQ ID NO: 1890 - protein, 427 aa, Arabidopsis thaliana
MCLLRHLLPIWVLLGFFFFSTATKSQESSVVYVSGASPEIPISQASPRMGAQSPGPPIVKVVLRQDLNKKILIALIVSSSLLCVTVMFLVYLLLWRYRNMKNSFTGIKRKSDSVKSVTTKPTVHKIDSVRKGTIPVYEYQLLESATNKFSDSNVLSRGGRGCLYRACLDEKSSVTVKKLDGGGETDIEKQFETEVDWLAKIRHQNIVSLLGFCVYRQTSCIVYELMQNGSLESQLHGPSQGSGLTWQLRMKIAVDIARGLEYLHEHCHPPVVHRDLKSSSILLDSDFNAKISDFGFATVLTTQNKNLIHKASEDLLDGKVTDKNDVYSFGVILLELLLGKKSVEKPSSEPESIVTWAVPKLSDRANLPNILDPAIKGTMDLKHLYQVAAVAVLCVQPEPSYRPLITDVLHSLIPLLPVELGGSLRIL

SEQ ID NO: 1891 - protein, 200 aa, Arabidopsis thaliana
LNKKILIALIVSSSLLCVTVMFLVYLLLWRYRNMKNSFTGIKRKSDSVKSVTTKPTVHKIDSVRKGTIPVYEYQLLESATNKFSDSNVLSRGGRGCLYRACLDEKSSVTVKKLDGGGETDIEKQFETEVDWLAKIRHQNIVSLLGFCVYRQTSCIVYELMQNGSLESQLHGPSQGSGLTWQLRMKIAVDIARGLEYLHEH

SEQ ID NO: 1892 - protein, 198 aa, Arabidopsis thaliana
KKILIALIVSSSLLCVTVMFLVYLLLWRYRNMKNSFTGIKRKSDSVKSVTTKPTVHKIDSVRKGTIPVYEYQLLESATNKFSDSNVLSRGGRGCLYRACLDEKSSVTVKKLDGGGETDIEKQFETEVDWLAKIRHQNIVSLLGFCVYRQTSCIVYELMQNGSLESQLHGPSQGSGLTWQLRMKIAVDIARGLEYLHEH

SEQ ID NO: 1893 - protein, 359 aa, Arabidopsis thaliana
MCLLRHLLPIWVLLGFFFFSTATKSQESSVVYVSGASPEIPISQASPRMGAQSPGPPIVKVVLRQDLNKKILIALIVSSSLLCVTVMFLVYLLLWRYRNMKNSFTGIKRKSDSVKSVTTKPTVHKIDSVRKGTIPVYEYQLLESATNKFSDSNVLSRGGRGCLYRACLDEKSSVTVKKLDGGGETDIEKQFETEVDWLAKIRHQNIVSLLGFCVYRQTSCIVYELMQNGSLESQLHGPSQGSGLTWQLRMKIAVDIARGLEYLHEHCHPPVVHRDLKSSSILLDSDFNAKISDFGFATVLTTQNKNLIHKASEDLLDGKVTDKNDVYSFGVILLELLLGKKSVEKPSSEPESIVTWYLS

SEQ ID NO: 1894 - protein, 200 aa, Arabidopsis thaliana; identical to SEQ ID NO: 1891

SEQ ID NO: 1895 - protein, 198 aa, Arabidopsis thaliana; identical to SEQ ID NO: 1892

SEQ ID NO: 1896 - protein, 389 aa, Arabidopsis thaliana
MEKTSMFSIHEGKPIRCKAAVSRKPGEALVIEEIHVDPPQAYEVRIKIICTSLCHTDVSFSKIDSGPLARFPRILGHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 1897 - protein, 593 aa, Xenopus tropicalis
MDTVLKCLPSNPDDHCSQRCRLGPKAMALIGAKVGFPVLVSLQSGSCLCTAWPRRDLCDGFVQADYMCSTSHKPMAVFKDTGICLNQIKSMASTKLRKVSVKVVVRSLDVKRATSEAALLETVRDLLRNVFVLNDYVLSVNADSPVVHIEILDTDPATSNAGLITGKTSIVIKEVITLEWYKHKLQEAPQLKVAAMDDTCASLKEIIHMPLHYPETMHKLGLPCPKGVLLIGPPGVGKTLLVKAVAREVGAYVIGLSGPAIHGSRPGESEENLRKIFEKAREAACSGPALLFIDEVDALCPKRGHSNSAPENRVVAQLLTLMDGIDSDNKMVTVAATSRPDAIDPALRRPGRFDREVIIGTPTHKQRQAILEMMISNMPTDRDVDAAALADVTVGYVGADLTALCRDAAMQAVLQASLDSLCNLVSRAHFYEAFKRIRPSSARSSIGRVEFKPVHWEHIGGLEDIKHKLRQSIEWPMKYPEAFSRMGLTPPKGVLLYGPPGCAKTTLVKAVATSCHCSFFSISAADLFSPYVGDSEKTLAQVSNRCSDKRGLALQPLFSLMKLMPWWGPDQKVEQDLGSRKGSFLFSLMSWMA

SEQ ID NO: 1898 - protein, 276 aa, Bos taurus
MKTSATSFIPGSLVLAFCLPVVATSPKTLAIPEKLQEAVGKVTVNATTCTVICGLGFKEETVCEVGPDGVRRKCKSQRLECLTNWLCGMLHFTLLIGKEFKLSCLSPDILEIGQGAFRFTWRLARGIISTDDEVFKPFRASSYFIKFQSIQEYDSGTYRCDVQLLKNLRLVKRLYFGLRVLPPNLVNLNFHQSLTEDQKLVDEGLEVNLDNYSRPQHPPWKKKVAIAVGIGVAGGVTGGVLVSIVLCGRLSVIHSSASLETLQALLPKGGMLRKPD

SEQ ID NO: 1899 - protein, 592 aa, Bos taurus
MAPGQLALFSVSDKNGLVEFARNLASVGLNLIASGGTAKALRDAGLAVRDVSELTGFPEMLGGRVKTLHPAVHAGILARDIPEDSADMAKLDFNLIRVVVCNLYPFGKTVASPGVTVEEAVEHIDIGGVTLLRAAAKNHARVTVVCEPEDYAAVASEMQDSDSKDTSLETRRQLALKAFTHTAQYDEAISDYFRKEYSKGVSQMPLRYGMNPHQTPAQLYTLKPKLPITVLNGAPGFINLCDALNAWQLVKELKEALGLPAAASFKHVSPAGAAVGIPLSEDEANVCMVYDLYKTLTPVATAYARARGADRMSSFGDFVALSDVCDVPTAKIISREVSDGIIAPGYENEALKILSKKKNGNYCVLQMDQSYIPDENEVRTLFGLRLSQKRNNSVVNRSLFSNIVTKNKDLPESALRDLIVATIAVKYTQSNSVCYAKNGQVIGIGAGQQSRIHCTRLAGDKANCWWLRHHPQVLSMKFKTGVKRAEISNAIDQYVTGTIGEGEDLIKWKALFEEVPELLTETEKKEWIDKLNEVSISSDAFFPFRDNVDRAKRSGVAYIAAPSGSAADKVVIEACDELGIILAHTNLRLFHH

SEQ ID NO: 1900 - protein, 189 aa, Bos taurus
MAAKQPPPLMKKHSQTDLVSRLKTRKILGVGGEDDDGEVHRSKISQVLGNEIKFAVREPLGLRVWQFVSAVLFSGIAIMALAFPDQLYDAVFDGAQVTSKTPIRLYGGALLSISLIMWNALYTAEKVIIRWTLLTEACYFSVQFLVVTATLAETGLASQGILLLLASRLLFVAISVYYYYQVGRKPKKV

SEQ ID NO: 1901 - protein, 140 aa, Mus musculus
AVCAVVWIISCVLGLPTLLSRELTHIEGKPYCAEKKPTSLKLMWGLVALITTFFVPLLSIVTCYCCITRRLCAHYQQSGKHNKKLKKSIKIVIIAVAAFTVSWVPFNTFKLLAIVSGFQPEGLFHSEALQLAMNVTGPLA

SEQ ID NO: 1902 - protein, 124 aa, Mus musculus
VCAVVWIISCVLGLPTLLSRELTHIEGKPYCAEKKPTSLKLMWGLVALITTFFVPLLSIVTCYCCITRRLCAHYQQSGKHNKKLKKSIKIVIIAVAAFTVSWVPFNTFKLLAIVSGFQPEGLFH

SEQ ID NO: 1903 - protein, 314 aa, Rattus norvegicus
MSSTAAFCLLSTLGGYLVTSFLLLKYPALLHQRKKQRFLSRHISHRGGAGENLENTMAAFQHAVTIGTDMLELDCHITKDEQVVVSHDANLKRSTGVNVNVSDLKYCELPPYLCKLDVPFQRACKCEGTDTRIPLLKEVFEAFPETPINIDIKVNNNVLIQKVSELVKQYKREHLTVWGNASSEIVDKCYKENSDIPILFSLQRVLLILGLFFTGLLPFVPIREQFFEIPMPSIILKLKEPHIISKGHKFLIWLSDTLLMRKALFDHLTARGIQVYIWVLNEEHEYKRAFDLGATGVMTDYPTKLKEFLNNMSA

SEQ ID NO: 1904 - protein, 150 aa, Rattus norvegicus
AAFQHAVTIGTDMLELDCHITKDEQVVVSHDANLKRSTGVNVNVSDLKYCELPPYLCKLDVPFQRACKCEGTDTRIPLLKEVFEAFPETPINIDIKVNNNVLIQKVSELVKQYKREHLTVWGNASSEIVDKCYKENSDIPILFSLQRVLL

SEQ ID NO: 1905 - protein, 382 aa, Alcanivorax borkumensis
MHPIVIVGTGLAGFNTVKEFRKLDKETPIVMLTADDGRNYSKPMLSAGFSKGKTADDLCMATPEKVAEQLNVDVRTGVHVAGIDATNKRVLLPDDHLDYSKLVLALGADTWTPPLEGDAVGEVFSVNDLMDYGKFRAAVEGKKTVTILGGGLIGCEFANDLSNGGFKVSLVEPMGRCLPLLLPEQASEAVGRGLADLGVQFHFGPLAKAVHHGDNGQLVTELSDGSQLESDVVLSAIGLRPRISLAKEAGLDTNRGILTDKSLRTSAEHIYALGDCAEVQGHVLPYVLPLMASARALAKTLAGETTEVSYGVMPVTIKTPACPVVVCPAAEGSEGAWEVEAEGNTVQALFRSKDGSLLGYALTGEAVKEKMKLNKELPAIMP

SEQ ID NO: 1906 - protein, 580 aa, Arabidopsis thaliana
MKFMKLGSKPDSFQSEGDNVRYVSSELATDVIVIIGDVKFYLHKFPLLSKSARLQKLITTSTSSSNEENQIHHHHHEDEIEIAEIPGGPASFEICAKFCYGMTVTLNAYNVVAARCAAEFLEMYETVEKGNLVYKIEVFLNSSILQSWKDSIIVLQTTRALSPYSEELKLTGRCLDSIASRASIDTSKVEWSYTYSKKKNLDNGLRKPQAVPRDWWVEDLCDLHIDLYKRALATIEARGNVSADVIGEALHAYAIKRIPGFSKSSSVQVTDFAKYRALADSIIELIPDEKRSVSSSFLTKLLRASIFLGCDEVAGLKNRVGERLDEANLGDVLLYDVELMQSLVEVFLKSRDPREDDVTAKASVAKLVDGYLAEKSRDSDNLPLQKFLSLAEMVSSFPRQSHDGVYRAIDMFLKEHPEMNKSEKKRICRLMDCRKLSAEACAHAVQNERLPMRVVVQVLFFEQVRANNNGSSSTGNSTPEVIPASRSTNTTDQEDTECWDTEDIKALRGELANLRLAKNQQESHNQGKLMKGGGLGVSRVFSKLWSGKERSGDMISSSGTSSPGSVNDDSKSSSSTSKKH

SEQ ID NO: 1907 - protein, 194 aa, Arabidopsis thaliana
CVRDKTKAIMIGAGTGFGVLVLVGGLWWLRKFLIKRRITKRKKKFFKRNGGLLLLQELNTREGYVEKTRVFNSRELEKATENFSENRVLGHGGQGTVYKGMLVDGRTVAVKKSKVIDEDKLQEFINEVVILSQINHRHVVKLLGCCLETEVPMLVYEFIINGNLFKHIHEEESDDYTMLWGMRLRIAVDIAGAL

SEQ ID NO: 1908 - protein, 200 aa, Arabidopsis thaliana
CVRDKTKAIMIGAGTGFGVLVLVGGLWWLRKFLIKRRITKRKKKFFKRNGGLLLLQELNTREGYVEKTRVFNSRELEKATENFSENRVLGHGGQGTVYKGMLVDGRTVAVKKSKVIDEDKLQEFINEVVILSQINHRHVVKLLGCCLETEVPMLVYEFIINGNLFKHIHEEESDDYTMLWGMRLRIAVDIAGALSYLHSS

SEQ ID NO: 1909 - protein, 103 aa, Arabidopsis thaliana
VSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHV

SEQ ID NO: 1910 - protein, 147 aa, Arabidopsis thaliana
VSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHVRMLTQEIRKSLDRHTILYTTLVELSKTLGLQNCAVWMPNDGGTE

SEQ ID NO: 1911 - protein, 457 aa, Arabidopsis thaliana
MNAKDVISRLPDEVLGRILSLISTKEAVSTSVLSKRWKNMFVLVSNLDIDDRQSVPKTKQNRIEIHRNYMAFVDKLLDTQRGSSIKKLTLKSHVGVRGGTDSSRIQSWICNVLDHGVMDLDVFITLKGKSPPVPAMIFKSKTLVKLRVGRGFTIKLSQDVSLPLLRTLCLDSVNFVGGHNVVGTLISRCPVLEELVVEERRCVDWTCSVSSPSLKRLHIRFDRKFTSISLDAPNLIYYKHSGYVLGKYPNVKLDSLIEARLNLRMDETRMVGVRNGSLGSIPADMRNLINGIRNVRILHLSSHTLELLYFSCKEMPLFDSLVSLSIGNDKARGWQMLPLLIKNSPNLETLIFMGLDHYITNRCGDVCVCYDTDESITSCLSSSQVKVLEILSYQGTTRELNQMKHFLEKLPCLELVKICVVNNSNNLQTTMEMRNLMMLPRASSKCKIQVKVLTKNN

SEQ ID NO: 1912 - protein, 152 aa, Arabidopsis thaliana
WICNVLDHGVMDLDVFITLKGKSPPVPAMIFKSKTLVKLRVGRGFTIKLSQDVSLPLLRTLCLDSVNFVGGHNVVGTLISRCPVLEELVVEERRCVDWTCSVSSPSLKRLHIRFDRKFTSISLDAPNLIYYKHSGYVLGKYPNVKLDSLIEA

SEQ ID NO: 1913 - protein, 188 aa, Arabidopsis thaliana
MAFVDKLLDTQRGSSIKKLTLKSHVGVRGGTDSSRIQSWICNVLDHGVMDLDVFITLKGKSPPVPAMIFKSKTLVKLRVGRGFTIKLSQDVSLPLLRTLCLDSVNFVGGHNVVGTLISRCPVLEELVVEERRCVDWTCSVSSPSLKRLHIRFDRKFTSISLDAPNLIYYKHSGYVLGKYPNVKLDSLI

SEQ ID NO: 1914 - protein, 496 aa, Arabidopsis thaliana
MELNCVQFLRNKTILVTGATGFLAKVFVEKILRVQPNVKKLYLLVRASDNEAATKRLRTEVFEKELFKVLRQNLGDEKLNTLLYEKVVSVPGDIATDQLGINDSHLRERMQKEIDIVVNVAATTNFDERYDVGLGINTFGALNVLNFAKKCVKVQLLLHVSTAYVCGEKPGLIPEKPFIMEEIRNENGLQLDINLERELMKQRLKELNEQDCSEEDITLSMKELGMERAKLHGWPNTYVFTKSMGEMLLGKHKENLPLVIIRPTMITSTLSEPFPGWIEGLRTVDSVIIAYGKGVLKCFLVDVNSVCDMIPVDMVANAMITAAAKHAGGSGVHMVYHVGSSHQNPVTFGEIHEIAVRYFTKNPLRSRNGSLITVSKVRFIPTMALFSLYMTLRYKLPLQLLKLVDIIYPWRNGDKYGDKNRKIELVMRLVELYEPYVLFKGIFDDRNTKSLCANQKEEEIKNTEKLMFDFDPKGINWGDYLTNIHISGLVTHVLKK

SEQ ID NO: 1915 - protein, 106 aa, Arabidopsis thaliana
VIHFVCQLGRIKEAHHLLLLMELKGYTPDVISYSTVVNGYCRFGELDKVWKLIEVMKRKGLKPNSYIYGSIIGLLCRICKLAEAEEAFSEMIRQGILPDTVVYTTL

SEQ ID NO: 1916 - protein, 53 aa, Arabidopsis thaliana
VRDTEFVHQITNVIKLRRAEPLRRSLKPYECKFKTDHLIWVLMKIKCDYRLVL

SEQ ID NO: 1917 - protein, 84 aa, Arabidopsis thaliana
PTLGESIAKSLIETDPLNYKYYHLLMNIYSVTGRWEDVNRVREMVKERKIGRIPGCGLVDLKEIVHGLRLGCKEAEKVFTETSL

SEQ ID NO: 1918 - protein, 74 aa, Arabidopsis thaliana
LIETDPLNYKYYHLLMNIYSVTGRWEDVNRVREMVKERKIGRIPGCGLVDLKEIVHGLRLGCKEAEKVFTETSL

SEQ ID NO: 1919 - protein, 68 aa, Arabidopsis thaliana
VKQGLHVFDIPAVASSICVATTDVLAEIQALKMKGEVTYELKDSAFCYTILKSPKEICSLSSHLTKWL

SEQ ID NO: 1920 - protein, 59 aa, Caenorhabditis elegans
TPGMLTSWISVSIPNCLIHSAHQNQLVKLLVSKDIPVVEPYLRTSCGFLGLCIGKFFKK

SEQ ID NO: 1921 - protein, 63 aa, Caenorhabditis elegans
TPGMLTSWISVSIPNCLIHSAHQNQLVKLLVSKDIPVVEPYLRTSCGFLGLCIGKFFKKLRNE

SEQ ID NO: 1922 - protein, 1165 aa, Schizosaccharomyces pombe
MGVNTAGDPQKSQPKINKGGIGKDESFGALFKPVYKGKKLADPVPTIEDKWQLLPAFLKVKGLVKQHLDSYNYFVDVDLKKIVQANEKVTSDVEPWFYLKYLDIRVGAPVRTDADAIQASISPHECRLRDLTYGANIYVDIEYTRGKQVVRRRNVPIGRMPVMLRSNKCVLSGKNEMEMAALNECPLDPGGYFIVKGTEKVILVQEQLSKNRIIVEAEPKKGLWQASVTSSTHERKSKTYVITKNGKLYLKHNSVADDIPIVVVLKAMGLQSDQEIFELVAGAEASYQDLFAPSIEECAKLNIYTAQQALEYIGARVKVNRRAGANRLPPHEEALEVLAAVVLAHINVFNLEFRPKAVYIGIMARRVLMAMVDPLQVDDRDYVGNKRLELAGQLLALLFEDLFKKFNSDLKLNIDKVLKKPHRTQEFDAYNQLTVHSDHITQGMVRALSTGNWSLKRFKMERAGVTHVLSRLSYISALGMMTRITSQFEKTRKVSGPRSLQASQFGMLCTSDTPEGEACGLVKNLALMTHITTDEEEEPIIKLAYAFGIEDIHVISGRELHSHGTYLVYLNGAILGISRYPSLFVASFRKLRRSGKISPFIGIFINTHQRAVFISTDGGRICRPLIIVQNGLPKVESKHIRLLKEGKWGFEDFLKQGLVEYVDVNEENDSLISVYERDITPDTTHLEIEPFTILGAVAGLIPYPHHNQSPRNTYQCAMGKQAIGAIAYNQLQRIDTLLYLMVYPQQPMVKTKTIELIGYDKLPAGQNATVAIMSYSGYDIEDALVLNKSSIDRGFGRCQVFHKHSVIVRKYPNGTHDRIGDPQRDPETGEVVWKHGVVEDDGLAGVGCRVQPGQIYVNKQTPTNALDNSITLGHTQTVESGYKATPMTYKAPEPGYIDKVMLTTTDSDQTLIKVLMRQTRRPELGDKFSSRHGQKGVCGVIVQQEDMPFNDQGICPDIIMNPHGFPSRMTVGKMIELLSGKVGVLRGTLEYGTCFGGTKVEDASRILVEHGYNYSGKDMLTSGITGETLEAYIFMGPIYYQKLKHMVMDKMHARARGPRAVLTRQPTEGRSRDGGLRLGEMERDCLIAYGASQLLLERLMISSDACDVDVCGQCGLLGYKGWCNSCQSTREVVKMTIPYAAKLLFQELLSMNIVPRLALEDEFKY

SEQ ID NO: 1923 - protein, 50 aa, Schizosaccharomyces pombe
LTPKWKHGPIYCSEVTGNLLINVMHVDEQYVKRLKLNQPYNIMGITVYVL

SEQ ID NO: 1924 - protein, 197 aa, Schizosaccharomyces pombe
WQSFGDANILEPLKNELVKNEESTMSELLLCPICGITLESLTVDANIHVNDCLDGRTTEAVSKKLKKDSVVKADPSNSSTFPISDSCKQALLPLPGKQINVRSVVPFYKLMPYNIPFAVDAFAYGAIDGVEAYFLSHFHSDHYGGLTPKWKHGPIYCSEVTGNLLINVMHVDEQYVKRLKLNQPYNIMGITVYVLDA

SEQ ID NO: 1925 - protein, 57 aa, Schizosaccharomyces pombe
ALYIGLVWTGHGILQRHAFLKSMKSGSTSQLTSMVSSVQKMKGFRTSVNSFVGLVLI

SEQ ID NO: 1926 - protein, 54 aa, Schizosaccharomyces pombe
IGLVWTGHGILQRHAFLKSMKSGSTSQLTSMVSSVQKMKGFRTSVNSFVGLVLI

SEQ ID NO: 1927 - protein, 85 aa, Bos taurus
DVIEVVPEPGQPLTKNKFKVLYEKEQKGPVTALCHCNGHLVSAIGQKIFLWSLRASELTGMAFIDTQLYIHQMISVKNFILAADV

SEQ ID NO: 1928 - protein, 67 aa, Bos taurus
VIEVVPEPGQPLTKNKFKVLYEKEQKGPVTALCHCNGHLVSAIGQKIFLWSLRASELTGMAFIDTQL

SEQ ID NO: 1929 - protein, 361 aa, Caenorhabditis elegans
MLRATNNRRTSNNVEKDSLQMAKHGNGPLKPVNAQGLQTKREAREILALKPSNPAPVETAQKSQRINLQDAETKCLAMADDIYKYLVHHEKKYLLEECFMEGGEPTPKMRRILVDWLVQVHVRFHLTPETLHLTVFILDRMLQKKVTSKADLQLLGISAMFVASKFEEVYLPDIHDYEFITENTYSKKQILAMEQTILNSLNFDLSCPSSLVFLRCLSRILSENDASPIDNQAFCYTYNISKCLGELALLDSVMASTPRSHIASASMIIALEVHPVDGIEAENAVSVICKQLGASKKVIEDAVALLAEVSYKNFKQGKLVAIKNKYQSSKLAQVSNLMTDDVLEKINRMGQNAKVDASEME

SEQ ID NO: 1930 - protein, 75 aa, Caenorhabditis elegans
VNEFMAIHLLTGDEPKIDRWTTSDYIFTTILLFLLLAATLFGILFMVCKQTLHKKGFMDDTVGLVARKKRVVVSK

SEQ ID NO: 1931 - protein, 85 aa, Caenorhabditis elegans
VNEFMAIHLLTGDEPKIDRWTTSDYIFTTILLFLLLAATLFGILFMVCKQTLHKKGFMDDTVGLVARKKRVVVSKRPMNEDNENS

SEQ ID NO: 1932 - protein, 75 aa, Caenorhabditis elegans; identical to SEQ ID NO: 1930

SEQ ID NO: 1933 - protein, 85 aa, Caenorhabditis elegans; identical to SEQ ID NO: 1931

SEQ ID NO: 1934 - protein, 75 aa, Caenorhabditis elegans; identical to SEQ ID NO: 1930

SEQ ID NO: 1935 - protein, 85 aa, Caenorhabditis elegans; identical to SEQ ID NO: 1931

SEQ ID NO: 1936 - protein, 75 aa, Caenorhabditis elegans; identical to SEQ ID NO: 1930

SEQ ID NO: 1937 - protein, 85 aa, Caenorhabditis elegans; identical to SEQ ID NO: 1931

SEQ ID NO: 1938 - protein, 75 aa, Caenorhabditis elegans; identical to SEQ ID NO: 1930

SEQ ID NO: 1939 - protein, 85 aa, Caenorhabditis elegans; identical to SEQ ID NO: 1931

SEQ ID NO: 1940 - protein, 159 aa, Schizosaccharomyces pombe
YVESLAVALRTESVTWVRYFLLMGGHIVLAKILQAIHEKKHLKSPDITLEIAILKSMRCIIGQKIGTDFYLSNKYPIDSVVHCLLSTKLLVRKLAAELLTFLCYSEKPNGINAIMKCMKNFANLKVESMNVFDLWLSQWKRTLLEKVVTEEKKVLEEAA

SEQ ID NO: 1941 - protein, 94 aa, Schizosaccharomyces pombe
LEVPFEKTLWNIVVADPYLLTLKLTAEGIFKQLEDCYPLREVTVSNKKVKEYTGFMPVDLQQMVSIRLHRFNSLTPIEIAKKFFHCDHDIMELV

SEQ ID NO: 1942 - protein, 503 aa, Caenorhabditis elegans
MPPDTRINKEIMVSWIRKNLLLVLTVSSVVLGALCGFLLRGLQLSPQNIMYISFPGELLMHMLKMMILPLIMSSLISGLAQLDARQSGKLGSLAVTYYMFTTAVAVVTGIFLVLVIHPGDPTIKKEIGTGTEGKTVSTVDTLLDLLRNMFPENVVQATFQQVQTKYIKVRPKVVKNNDSATLAALNNGSLDYVKASVEYTSGMNVLGVIVFCIAIGISLSQLGQEAHVMVQFFVIMDKVIMKLVMTVMWYSPFGIFCLIMGKILEIHDLADTARMLAMYMVTVLSGLAIHSLISLPLIFFVTTKKNPYVFMRGLFQAWITALGTASSSATLPITFNCLEENLGVDRRVTRFVLPVGATINMDGTALYEAVAAIFIAQINGVHLSFGQVVTVSLTATLASIGAASVPSAGLVTMLLVLTAVGLPVKDVSLIVAVDWLLDRIRTSINVLGDAMGAGIVYHYSKADLDAHDRLAATTRSHSIAMNDEKRQLAVYNSLPTDDEKHTH

SEQ ID NO: 1943 - protein, 492 aa, Caenorhabditis elegans
MVSWIRKNLLLVLTVSSVVLGALCGFLLRGLQLSPQNIMYISFPGELLMHMLKMMILPLIMSSLISGLAQLDARQSGKLGSLAVTYYMFTTAVAVVTGIFLVLVIHPGDPTIKKEIGTGTEGKTVSTVDTLLDLLRNMFPENVVQATFQQVQTKYIKVRPKVVKNNDSATLAALNNGSLDYVKASVEYTSGMNVLGVIVFCIAIGISLSQLGQEAHVMVQFFVIMDKVIMKLVMTVMWYSPFGIFCLIMGKILEIHDLADTARMLAMYMVTVLSGLAIHSLISLPLIFFVTTKKNPYVFMRGLFQAWITALGTASSSATLPITFNCLEENLGVDRRVTRFVLPVGATINMDGTALYEAVAAIFIAQINGVHLSFGQVVTVSLTATLASIGAASVPSAGLVTMLLVLTAVGLPVKDVSLIVAVDWLLDRIRTSINVLGDAMGAGIVYHYSKADLDAHDRLAATTRSHSIAMNDEKRQLAVYNSLPTDDEKHTH

SEQ ID NO: 1944 - protein, 73 aa, Oryza sativa
FGSILGVKLIRAALPKVGKGAPLSVGVHHGALAEGLATFMVVIVSVTLKKKEMKGFFMKTWISSIWKMTFHLL

SEQ ID NO: 1945 - protein, 134 aa, Oryza sativa
SILGVKLIRAALPKVGKGAPLSVGVHHGALAEGLATFMVVIVSVTLKKKEMKGFFMKTWISSIWKMTFHLLSSDITGGVMNPASAFAWAYARGDHTTFDHLLVYWLAPLQATLLGVWVVTLLTKPKKIEEEADE

SEQ ID NO: 1946 - protein, 178 aa, Caenorhabditis elegans
VKPADDEIVQKIRNQMSGALWSAAQFAVTSYVCVRVLKFLYIMCKSVLVHFITPKHDLDYLKDTWTVITGGTDGIGKAYIEELCKTRGLKKFYLIGRNIDKLNNTKKELVEQHGCEVMCHVHDFEKDDLSALPKDLETLDVGILINCAGIAPHIIGTLTELPEGLASKILRVNLMSAV

SEQ ID NO: 1947 - protein, 33 aa, Caenorhabditis elegans
VLKFLYIMCKSVLVHFITPKHDLDYLKDTWTVI

SEQ ID NO: 1948 - protein, 158 aa, Trichodesmium erythraeum
MTTIKLMHAKLHRVRVTDAKPDYVGSVTIDSDLLEKVGILPLEEVQIVNLNNGQRWLTYVLPGQAGSGMVCPNGGAALLCKKDDILIIWANEQCDRAEVLENGHKAKIFVADENNHCREFLYQILNPNQGSVEFHSLPVIPEGKTSEYLQQMIETNKI

SEQ ID NO: 1949 - protein, 327 aa, Saccharomyces cerevisiae
MASSVPGPIDLPESRYDLSTYWGRIRHCAEISDPTMLLTTEKDLAHAREIISAYRHGELKETTPEFWRAKKQLDSTVHPDTGKTVLLPFRMSSNVLSNLVVTVGMLTPGLGTAGTVFWQWANQSLNVAVNSANANKSHPMSTSQLLTNYAAAVTASCGVALGLNNLVPRLKNISPHSKLILGRLVPFAAVVSAGIVNVFLMRGNEIRKGISVFDSNGDEVGKSKKAAFMAVGETALSRVINATPTMVIPPLILVRLQRGVLKGKSLGVQTLANLGLISVTMFSALPFALGIFPQRQAIHLNKLEPELHGKKDKDGKPIEKVYFNRGI

SEQ ID NO: 1950 - protein, 120 aa, Saccharomyces cerevisiae
LIPKITVFSKVKTKNALTVSMFKNVLKQKFGAKPGTRIGMTPCVVWVNTEYDVTSNIHVTMTHSSLLNASKIVKETLQLRNNSPLFSICSHTSGLGFMFSCLLGIYTGASTCLFSLTDVL

SEQ ID NO: 1951 - protein, 200 aa, Saccharomyces cerevisiae
PVCTDVSVVNPETLLPCVDGEFGEIWCCSEANAFDYFVCNSSKNKLYKDPFITEQFKSKMKSEVNNTLSYLRTGDLGFIKNVSCTNSQGEVVNLNLLFVLGSIHESIEILGLTHFVSDLERTVKDVHSDIGSCLIAKAGGLLVCLIRCKERHNPILGNLTTLIVSELLNKHGVILDLCTFVRTKGISPKNSSMIMEVWAK

SEQ ID NO: 1952 - protein, 135 aa, Saccharomyces cerevisiae
VGAHPFETHQDDNIKYSSHLEQTLDVAYTRCCHLREILPIPSTLRQVKGKTAPLQTLKFLNPKPTLVDILSFCDFIAITPIHNIIFDNVSLTHDMFKIVICSLVTSPVVEKLGLRNVVINEQSWKLLCKFLLQNK

SEQ ID NO: 1953 - protein, 68 aa, Saccharomyces cerevisiae
FCDFIAITPIHNIIFDNVSLTHDMFKIVICSLVTSPVVEKLGLRNVVINEQSWKLLCKFLLQNKTLIK

SEQ ID NO: 1954 - protein, 292 aa, Saccharomyces cerevisiae
MEDSKKKGLIEGAILDIINGSIAGACGKVIEFPFDTVKVRLQTQASNVFPTTWSCIKFTYQNEGIARGFFQGIASPLVGACLENATLFVSYNQCSKFLEKHTNVSPLGQILISGGVAGSCASLVLTPVELVKCKLQVANLQVASAKTKHTKVLPTIKAIITERGLAGLWQGQSGTFIRESFGGVAWFATYEIVKKSLKDRHSLDDPKRDESKIWELLISGGSAGLAFNASIFPADTVKSVMQTEHISLTNAVKKIFGKFGLKGFYRGLGITLFRAVPANAAVFYIFETLSAL

SEQ ID NO: 1955 - protein, 516 aa, Saccharomyces cerevisiae
MFLAKNLKNNKIKVCLPKKKFAALSTASIQTNERPNPDKVLKDIAKYVHETPLKSSLALDTARLCFLDTLGCGLAALKFKQAQNIIKPIVPGTIVPSGTKILGTSYVMDPVKGAFAIGTLIRWLDYNDCWLAAEWGHPSDNLGGILAVADHLSRLNKATHGKNGKQFLVKDVLEAMIKAHEIQGIIALENSFNKVGLDHVVLVKVATAGVVSKMLGLSQEQTIEALSQAFVDGQSLRTYRHAPNTGSRKSWAAGDAVSRAVNLAYLVKNANVGTIPSVLTARTWGFYDVLFKGKPFSFQQRSKYDSYVMENVLFKISFPAEFHAQTAVEAAVKAYRILAKQGKTFKDIKSIRIRTQEAAMRIIDKSGPLYNYADRDHCIQYMIAVPLITGNLTATDYSDEVARNPEIDNLRSKMYCIEDTHLTQNYHDPDKRSIGNALLIELNDGTQLDEIFVEYPVGHKFRREEGIPLLMNKFQRHLREHFVESPDKVDLIMKVSSKTNFLNMQIDKYMDLFTEG

SEQ ID NO: 1956 - protein, 344 aa, Saccharomyces cerevisiae
MFKSLAAVLPRASKAKFLQKNYASTLAFIESSKDGSVSRSSLSLLAAAQKLSNPITAVITGSKAEKTAEALKSSYSCSNLEKLVIFEDSKLDTCLPEQLTPLLVKLLKGGDYSHFVVSNSSVGKSVLPRVGALLDVQPVCEVTVIKDPKTFIRPIYAGNIISTIECQAEKKLLIIRASAFPPIAEGSMDSVTIEKRTDIPPCDLNVTWVKTILTKSERPELTSAQNVVTGGRALKDKETFEKLLSPLADVLHAAIGATRASVDNGLCDNSLQIGQTGKVVAPNLYIAIGVSGAVQHLAGMKDSKVIVAINNDPDAPIFNVADYGLQGDLYKIVPELTEKLGKYK

SEQ ID NO: 1957 - protein, 339 aa, Saccharomyces cerevisiae
MAGSTSSLVICAIGIYATFLTWALVQEPLATRTWPNSMGKFQFPNVISLIQASVAMMMGYLYLNWKKVEYPPRKMIKDHWKQLMLISFTQSSSGPLATTSLKHVDYLTYMLAKSCKMIPVLLVHLLLYRTPIASQKKVVALLVSLGVTIFTIGGNDGKKLKRSFNESGNDNKLQGFGLLFSSLFLDGLTNATQDKLLKANKAKEKGKQTLITGAHLMFTLNLFVILWNILYFIVIDCKQWDNAVSVLTMDPQVWGYLMLYSFCGAMGQCFIFYTLEQFGSLVLIMITVTRKMVSMILSIIVFGKSVRFQQWVGMFIVFGGITWEALNKKKANIPKAKSA

SEQ ID NO: 1958 - protein, 135 aa, Saccharomyces cerevisiae
ALVQEPLATRTWPNSMGKFQFPNVISLIQASVAMMMGYLYLNWKKVEYPPRKMIKDHWKQLMLISFTQSSSGPLATTSLKHVDYLTYMLAKSCKMIPVLLVHLLLYRTPIASQKKVVALLVSLGVTIFTIGGNDG

SEQ ID NO: 1959 - protein, 104 aa, Saccharomyces cerevisiae
VISLIQASVAMMMGYLYLNWKKVEYPPRKMIKDHWKQLMLISFTQSSSGPLATTSLKHVDYLTYMLAKSCKMIPVLLVHLLLYRTPIASQKKVVALLVSLGVTI

SEQ ID NO: 1960 - protein, 438 aa, Aspergillus oryzae
MPITKIHARSVYDSRGNPTVEVDVVTETGLHRAIVPSGASTGQHEAHELRDGDKTHWGGKGVLKAVENVNKTIAPAVIEENLDVKDQSKVDEFLKKLDGSANKSNLGANAILGVSLAIAKAGAAEKGVPLYAHISDLAGTKKPYVLPVPFQNVLNGGSHAGGRLAFQEFMIVPSAAPSFSEALRQGAEVYQKLKTLAKKKYGQSAGNVGDEGGVAPDIQTAEEALDLITEAIEQAGYTGKMKIAMDVASSEFYKADVKKYDLDFKNPDSDSSKWLTYEQLADLYKTLASKYPIVSIEDPFAEDDWEAWSYFYKTSDFQIVGDDLTVTNPLRIKKAIETKACNALLLKVNQIGTLTESIQAAKDSYADNWGVMVSHRSGETEDVTIADIAVGLRSGQIKTGAPARSERLAKLNQILRIEEELGNNAIYAGEKFRTSVNL

SEQ ID NO: 1961 - protein, 403 aa, Candida tropicalis
MALPPVYIVSTARTPIGSFQGSLSSLTYSDLGAHAVKAALAKVPQIKPQDVDEIVFGGVLQANVGQAPARQVALKAGLPDSIVASTINKVCASGMKAVIIGAQNIICGTSDIVVVGGAESMSNTPYYLPSARSGARYGDAIMVDGVQKDGLLDVYEEKLMGVAAEKCAKDHGFSREDQDNFAINSYKKAGKALSEGKFKSEIAPVTIKGFRGKPDTVIENDEEIGKFNEERLKSARTVFQKENGTVTAPNASKLNDGGAALVLVSEAKLKQLGLKPLAKISGWGEAARTPFDFTIAPALAVPKAVKHAGLTVDRVDFFELNEAFSVVGLANAELVNIPLEKLNVYGGAVAMGHPLGCSGARIIVTLLSVLTQEGGRFGVAGVCNGGGGASAVVIEKIDADAKL

SEQ ID NO: 1962 - protein, 32 aa, Saccharomyces cerevisiae
HFGKDITFWCTSLVLALLPITLDIVYKTFKVM

SEQ ID NO: 1963 - protein, 193 aa, Saccharomyces cerevisiae
VHIHQKKWEKLRVGDFVLLTQDDWVPADLLLLTCDGENSECFVETMALDGETNLKSKQPHPELNKLTKAASGLANINAQVTVEDPNIDLYNFEGNLELKNHRNDTIMKYPLGPDNVIYRGSILRNTQNVVGMVIFSGEETKIRMNALKNPRTKAPKLQRKINMIIVFMVFVVATISLFSYLGHVLHKKKYIDQ

SEQ ID NO: 1964 - protein, 183 aa, Saccharomyces cerevisiae
ALDAVHAVLLNPPVAPTAEHVAAVFVADFCDKQLAGILNDLSNLSNKQLKAQKTKEDINASVMRSLRLITSVVSTGQWPSSQIEPLCDVLLGVTKSSEQYLVSASFECFESMFKTMAETTISSGLAENKYLRVLDTIFALKPSNVDTLLTKSWIAVVIKGMSTYATHQPLKALRKIPGVFHIM

SEQ ID NO: 1965 - protein, 55 aa, Saccharomyces cerevisiae
VLDTIFALKPSNVDTLLTKSWIAVVIKGMSTYATHQPLKALRKIPGVFHIMCTYL

SEQ ID NO: 1966 - protein, 463 aa, Bos taurus
MAASVFYSRLLAAATLRSHRPRTALPAAAQVLGSSGLFNNHGVQIQHQQQRNLSLHEYLSMELLQEAGVSIPKGHVAKSPDEAYAIAKKLGSKDVVIKAQVLAGGRGKGTFESGLKGGVKIVFSPEEAKAVSSQMIGKKLFTKQTGEKGRICNQVLVCERRYPRREYYFAITMERSFQGPVLIGSSHGGVNIEDVAAETPEAIVKEPIDIVEGIKKEQAVRLAQKMGFPASIVDSAAENMIKLYDPFLKYDATMVEINPMVEDSDGAVLCMDAKINFDSNSAYRQKKIFDLQDWTQEDERDKDAAKADLNYIGLDGNIGCLVNGAGLAMATMDIIKLHGGTPANFLDVGGGATVHQVTEAFKLITSDKKVLSILVNIFGGIMRCDVIAQGIVMAVKDLEIKIPIVVRLQGTRVDDAKALIADSGLKILACDDLDEAAKMVVKLSEIVTLAKQAQVDVKFQLPI

SEQ ID NO: 1967 - protein, 149 aa, Mus musculus
EKVYAVDQHCFNVLIFPAHLKTDLLNIDLIKDYKLIFQDKSRSLAVHSVKALINIDDDVLMVNTGSWYTVAHMSILTSGHTSKIFVCGIQQEEKDFNARKLFTRMGCQNIEILHETFLSIESKDHRLQNVKVILLLPRCSSLGVSNPVE

SEQ ID NO: 1968 - protein, 49 aa, Mus musculus
LIKDYKLIFQDKSRSLAVHSVKALINIDDDVLMVNTGSWYTVAHMSILT

SEQ ID NO: 1969 - protein, 149 aa, Mus musculus; identical to SEQ ID NO: 1967

SEQ ID NO: 1970 - protein, 49 aa, Mus musculus; identical to SEQ ID NO: 1968

SEQ ID NO: 1971 - protein, 147 aa, Mus musculus
FPAHLKTDLLNIDLIKDYKLIFQDKSRSLAVHSVKALINIDDDVLMVNTGSWYTVAHMSILTSGHTSKIFVCGIQQEEKDFNARKLFTRMGCQNIEILHETFLSIESKDHRLQNVKVILLLPRCSSLGVSNPVEFILNEHEVTKVQA

SEQ ID NO: 1972 - protein, 49 aa, Mus musculus; identical to SEQ ID NO: 1968

SEQ ID NO: 1973 - protein, 149 aa, Mus musculus; identical to SEQ ID NO: 1967

SEQ ID NO: 1974 - protein, 49 aa, Mus musculus; identical to SEQ ID NO: 1968

SEQ ID NO: 1975 - protein, 42 aa, Mus musculus
IDNCAPLLSTFVLGKDFTRTKWVKNALEVHGVAILQSYLCYI

SEQ ID NO: 1976 - protein, 73 aa, Mus musculus
KWVKNALEVHGVAILQSYLCYIVGLFPLAAVPSNLTCTLFRCLFLIAFVTFFHCFAILPVILTFLPPSKKKRK

SEQ ID NO: 1977 - protein, 42 aa, Mus musculus; identical to SEQ ID NO: 1975

SEQ ID NO: 1978 - protein, 73 aa, Mus musculus; identical to SEQ ID NO: 1976

SEQ ID NO: 1979 - protein, 315 aa, Caenorhabditis elegans
MNIEWFAIGVGAIVVLYILYHFIKMIWSILGLYVFYQPIDLKKKAGASWAVITGGTDGIGKSFSFELAKRGFNIYIVSRTQSKLEQTKKEIMEKYSNVEVRFATFDFTNPSISDYKKLLSQLNEVSIGMLINNVGMLFEYPENLHKTVGGIDVVANVTILNTLPVTLLSAGILPQMVSRKTGIIVNIGSVAGAAKMAEWSVYSASKKYVEWLTGCLRKEYEHQGIIIQAITPALVATKLSGHTETSLFCPDSATFAKSALNTVGHTSQTTGYINHQIQCEMLALFPECFLDSFVKKSSVETREKALAKKENKHLL

SEQ ID NO: 1980 - protein, 422 aa, Caenorhabditis elegans
MLSSLRRVVPSLPRGSRSLTSQQIFDREKKFGCHNYKPLPVALSKGEGCFVWDVEGKKYFDFLAAYSAVNQGHCHPKLLKVVQEQASTLTLTSRAFYNNVLGEYEEYVTKLFKYDKVLPMNTGVEACESAVKLARRWAYDVKGVKDNEAVVVFAENNFWGRSIAAISASTDPDSFARFGPFVPGFKTVPYNNLKAVEDAIKDKNVAAFMVEPIQGEAGVVLPDPGYLKGVSDLCKKYNVLFITDEVQSGLGRSGKLLAHYHDNVRPDIVVLGKALSGGFYPVSAVLCDDNVMMNIKPGEHGSTYGGNPLACKVAIAALEILQEEKLVENSAVMGDLLMSKLKTLPKDIVSTVRGKGLFCAIVINKKYDAWKVCLKLKENGLLAKNTHGDIIRFAPPLCINKEQVEQAADIIIKTVTDFAKQN

SEQ ID NO: 1981 - protein, 871 aa, Caenorhabditis elegans
MLTLLNRWRSQPGGASNAAAFIRVLESPKSAVTDKVLVLKAFNDWDVLVNTWFEVADALPAVEQLLDNNTFPEHSSAALLVSKVYFCLEQYERALEFALRGDFNVVPATRTGLGNDAEYVNKIIETAIDTYKTLSKQGSGIPQKLRDLIDRIVARNLDKREIWFVISLGFETTNLAMIDRAISAMPADLTIKNQTTLVETLNRVVNGAFDRSFRFQVIDTVIKTYLKCPSPDMSKICECYVLTDNAEAAADTITSLIAKSLSTRAYQIAFDLYETASQGFLDRVLKRFQQQDARDEKSMEKIHSILKGHETVKAYLDFFVRHNHTDSVLMEEIKENIRTASAHNALLISNGLMQYGTTCDDFLRNNLNWVSKATNWNKFNAVASLGLIHHGQESSAMKVLEPYLPKESVEGFGFKEGGAMLAYGLIHAKHGDATAMSTLAQWLKTAENEPVRHGACLGFGVAGLGSSSVSNYEKVREVLQRDEAVSGESAGIAMGLIMAGHLNQEVFNELKQYTVDTQHDKTQRGIRTGLACAAFGLQGDAEPYIKEAIGAKSNPMLRSTGICMLSMAYAGTGSPDVVRRLLEKVATDPNLDVKRYATIGIGFVLSKDPSTCLSYVAMLTEHFNGHVRYGAAMALGIACAGTGNMEAIALIEPMISDKEGFVRKGALLSLALIMCQQTDYTCPKVNGFRKQLLKKIGEKNEDSLVKFGAIIAQGLLDIGGQNAAVTMQNSDKQPDMGSMVGMMCFLHGWFWHSMHFFIALAAKPSCLVMMNENLKIPVLDYICHANSQKFAYPPRAESKKDKDVKKIETVVLSITGKKNASKKLIAEEKKRREAAASASSAAAAPSSSSTSGTAPAAEDEKMEVDQPGKSK

SEQ ID NO: 1982 - protein, 37 aa, Caenorhabditis elegans
MVLPLILTLVIVAPIFLWMYSWYISAIPKHYVKPGTK

SEQ ID NO: 1983 - protein, 78 aa, Caenorhabditis elegans
MVLPLILTLVIVAPIFLWMYSWYISAIPKHYVKPGTKLQKKVHSNLRILEQKYHPSWWCPFGTTQTVVRQIFRDCPSL

SEQ ID NO: 1984 - protein, 214 aa, Caenorhabditis elegans
MSNQKPVLYSYWRSSCSWRVRIALALKNVDYEYKTVDLLSEEAKSKLKEINPAAKVPTFVVDGQVITESLAIIEYLEETHPDVPLLPKDPIKRAHARAISLLVASGIQPLHNLKVLQLLNKKEAGFGGQFAKQFVVEGLTALEILLKQHSGKYAVGDDVTIADLSIPPLIYSANRFNLDLSPYPTVNRINETLADIPAFIAAHPDNQPDTGLNA

SEQ ID NO: 1985 - protein, 308 aa, Suncus murinus
MVASAEADVPPPTMLVKIASAGLSACLADIITFPLDTAKVRLQVQGERPNAPGVKYKGVLGTIATVAKTEGPLKLYGGLPAGIQRQISFASLRIGLYDTVQEYFNAHRKTPATLGNKISAGLMTGCVTVFIGQPTEVAKVRMQAQSSLHWLKPRYSGTYNAYYVIVKTEGFLGLWKGTSLNLTRNVIINCTELVVYDVLKEALVKNNVLADDIPCHLLAALTAGFCTTALASPVDVVKTRFINSPPGYYPHVHNCALNMLQKEGLRAFFKGFVPSFLRLGSWTVIMHVTFEQLKKELMKSRQTVDCAT

SEQ ID NO: 1986 - protein, 303 aa, Caenorhabditis elegans
MATIVPTLFSFVRDTYKGRFDVATFEREVGRDFDNQEIAQAISKYEQEAKNLRNKDEIRKVIQYIDLTTLNGDDTASKVVALAKRAINPVPTDPSIHCGSVCVYPQRIADVKKFLASSKLNSNITSVAGGFPSGQYHLKSKVLEVELSVADGATEIDIVISRASALDEDWKTVHDEVLACKKACGSAHLKTILATGELKTLSNVYRASWASILAGSDFIKTSTGKESVNATLEVAYVMCTAIKRWHELTGKKVGFKPAGGIKTVDEALSYVALVKDILGDEWLNPHLFRIGASSLLDDCLKGL

SEQ ID NO: 1987 - protein, 146 aa, Caenorhabditis elegans
MLRILTVVLALVTIATVHAELSKKKEDKTLKDLEDKIVNDVMTHKVMVYSKTYCPWSKRLKAILANYEIDDMKIVELDRSNQTEEMQEILKKYSGRTTVPQLFISGKFVGGHDETKAIEEKGELRPLLEKAHALFTNRVPVPDNGA

SEQ ID NO: 1988 - protein, 349 aa, Caenorhabditis elegans
MELGNFVTDLNGKKCVKCDKDAKFTGVDPKKAWYCQECFVQMVRNKFRSSLSKKKIYKDADARDTLIVFDGTLSGTFLLHQINDALKQITYKRLMVKPTVLVLVSLTEDTEIQMVIKRIQEIKKSVLENVRWVVAHLACSMYDEDFKLKENECNGVEKISDYNQLIASCSVPTYRKELERVLKEKCLQKIACSMGILKCMVPDHADDLGRLAIDQLCLGRGGSISTLVTVTDKRPDFMLIRPLCDISKKELAVYNYLCDIDKHCIHIAQQNNQQKSVQTLTDAFICTLENEKFYSTINTVLSTAAKIHNTSIGKDDSKCSFCNVEVADSVCSTCSAIRECTGDLLTLLF

SEQ ID NO: 1989 - protein, 79 aa, Caenorhabditis elegans
FDGTLSGTFLLHQINDALKQITYKRLMVKPTVLVLVSLTEDTEIQMVIKRIQEIKKSVLENVRWVVAHLACSMYDEDFK

SEQ ID NO: 1990 - protein, 83 aa, Caenorhabditis elegans
FDGTLSGTFLLHQINDALKQITYKRLMVKPTVLVLVSLTEDTEIQMVIKRIQEIKKSVLENVRWVVAHLACSMYDEDFKLKEN

SEQ ID NO: 1991 - protein, 132 aa, Arctogadus glacialis
WSKIDIDVCGPLALQRCLIVYPWTQRYFGSFGDLSTVAAIMGNPKVAQHGVVALTGLRTALDHMDEIKSTYAALSVLHSEKLHVDPDNFRLLCECLTIVIAGKMGKKLSPDMQAAWQKYLCAVVSALGRQYH

SEQ ID NO: 1992 - protein, 143 aa, Arctogadus glacialis
MSLSSKDKATVKLFWGRMSGKAELIGADALSRMLAVYPQTKIYFSHWKSLSPGSSEVKKHGKTIMMGIGDAVTKMEDLERGLLTLSELHAFKLRVDPTNFKLLSLNILVVMAIMFPEDFTPMAHLAVDKFLCALALALSEKYR

SEQ ID NO: 1993 - protein, 143 aa, Boreogadus saida
MSLSAKDKATVKLFWGKMSGKSELIGADALSRMLAVYPQTKIYFSHWKSCSPGSPEVKKHGKTIMMGIGEAVTKMDDLERGLLTLSELHAFKLRVDPTNFKLLSLNILVVMAIMFPLDFTPMAHLAVDKFLCALALALSEKYR

SEQ ID NO: 1994 - protein, 548 aa, Zea mays
MAAPTLTTDGPRLGQQEMKKMSPSFHPTLWGDFFLSYEAPTEAQEAEMRQRAEVLREEVRNMIKGSHDVPEIVDLIITLQRLNLDYHYEDEINEKLAVVYNSNYDGGNLDLVSRRFYLLRKCGYHVSSDVFLNFKDQYGNFIEVDTRSLLSLYNAAYLRIHGETVLDEAISFTTRCLQDRLEHLESPIAEEVSSALDTPLFRRVGTLEMKDYIPIYEKDAKQNKSILEFAKLNFNLLQLLYSSELKECTTWWKELRVESNLSFVRDRIVEVYFWMSGGCYDPQYSHSRIILTKIVAFITILDDTLDSHANSYESMQLAEAVERWDESAVSLLPEYMKDFYMYLLKTFSSFENELGPDKSYRVFYLKEAVKELVREYTKEIKWRDEDYVPKTLKEHLKVSLISIGGTLVLCSAFVGMGDVVTKKIMEWVMSDAELVKSFGIFVRLSNDIVSTKREQREKHCVSTVQCYMKQHELTMDEACEQIKELTEDSWKFMIEQGLALKEYPIIVPRTVLEFARTVDYMYKEADKYTVSHTIKDMLTSLYVKPVLM

SEQ ID NO: 1995 - protein, 167 aa, Bos taurus
DCFTGDCFYLVNLKSDLWQPRPEGAPVETHHLSSENHLKLKPKANTKVICKRCKVMLGETVSSETTKFYMTEIIILPSERNFPIIPRSQFVQSVLAQCVVELSSARSTFRFTIQGHDDKVYILLWLLNSDSLVIESLGQYTNIKKFPVLEDVLKPDSNSACNAVKVL

SEQ ID NO: 1996 - protein, 138 aa, Bos taurus
HHLSSENHLKLKPKANTKVICKRCKVMLGETVSSETTKFYMTEIIILPSERNFPIIPRSQFVQSVLAQCVVELSSARSTFRFTIQGHDDKVYILLWLLNSDSLVIESLGQYTNIKKFPVLEDVLKPDSNSACNAVKVL

SEQ ID NO: 1997 - protein, 434 aa, Sus scrofa
MAMQKIFAREILDSRGNPTVEVDLHTAKGRFRAAVPSGASTGIYEALELRDGDKSRYLGKGVLKAVEHINKTLGPALLEKKLSVVDQEKVDKFMIELDGTENKSKFGANAILGVSLAVCKAGAAEKGVPLYRHIADLAGNPDLVLPVPAFNVINGGSHAGNKLAMQEFMILPVGASSFREAMRIGAEVYHHLKGVIKGKYGKDATNVGDEGGFAPNILENNEALELLKTAIQAAGYPDKVVIGMDVAASEFYRNGKYDLDFKSPDDPSRHITGEKLGELYKSFIKNYPVVSIEDPFDQDDWKTWTSFLSGVNIQIVGDDLTVTNLKRIAQAVEKKACNCLLLKVNQIGSVTESIQACKLAQSNGWGVMVSHRSGETEDTFIADLVVGLCTGQIKTGAPCRSERLAKYNQLMRIEEALGDKAVFAGRKFRNPKAK

SEQ ID NO: 1998 - protein, 70 aa, Bos taurus
QLALDFTPLKSLILYGTDGSGTRVGLLNANREGIISVLGYVAVHMAGVQTGLYVLKKRSHIKDWIKVACC

SEQ ID NO: 1999 - protein, 32 aa, Bos taurus
VQTGLYVLKKRSHIKDWIKVACCILLTAIGLF

SEQ ID NO: 2000 - protein, 145 aa, Bos taurus
VLRFGKVDVTEIQIALVIVFVLSTFGGATMWDYTIPILEIKLKILPVLGVVGGAIFSCSNYFHVILHGGVGKNGSTIAGTSVLSPGLHIGIIIILAIMIYKKSATNLFEKHPCLYTLMFGCVFAKVSQKLVIAHMTKSELYLQDT

SEQ ID NO: 2001 - protein, 103 aa, Bos taurus
TMWDYTIPILEIKLKILPVLGVVGGAIFSCSNYFHVILHGGVGKNGSTIAGTSVLSPGLHIGIIIILAIMIYKKSATNLFEKHPCLYTLMFGCVFAKVSQKLV

SEQ ID NO: 2002 - protein, 109 aa, Bos taurus
SSWTYKDDPCQKYYELLLVNPIWLVPPTKALAVTFTNFVTEPLKHVGKGAGEFIKALMKEIPVLLHIPVLIIMALAVLSFCYGAGKSVNMLRHVGGPEREAPQALQAGE

SEQ ID NO: 2003 - protein, 64 aa, Bos taurus
WLVPPTKALAVTFTNFVTEPLKHVGKGAGEFIKALMKEIPVLLHIPVLIIMALAVLSFCYGAGK

SEQ ID NO: 2004 - protein, 427 aa, Bos taurus
MALRITRNTKISAENKAKISMAGAKRVPVAAVATSKPGLRPRTALGDIGNKVSEQPQAKLPLKKEAKTLASGKVTAKKVPKPLEKAPVPVPEPQPEPEPEPEHVKEDKLSPEPILVDTPSPSPMETSGCAPAEEYLCQAFSDVILAVSDVDAEDGADPNLCSEYVKDIYAYLRQLEEEQAVKPKYLMGREVTGNMRAILIDWLVQVQIKFRLLQETMYMTVSIIDRFMQDTYVPKKMLQLVGVTAMFVASKYEEMYPPEIGDFAFVTDNTYTKFQIRQMEMKILRALNFSLGRPLPLHFLRRASKIGEVDVELHTLAKYLMELTMLDYDMVHFPPSQIAAGAFCLALKVLDNGEWTPTLQHYLSYTEESLLVVMQHLAKNVVMVNRGLTKHMTIKNKYATSKHAKISTLAQLNSALVQDLAKAVAKV

SEQ ID NO: 2005 - protein, 523 aa, Bos taurus
MAGQQALLLFGFILPGLLFSEAAKILTVSLVGGSHFLLMHQISQILQDHGHNVTMLLQKGNLLLPGFKEEEKSYKVFNWFLPEDCNEEFKRSFHSFMEKTFGGRCKFEHFLNIMELLGHHCSHLLRRKDVMKSLKNENFDLVIVEMFDYCPFLVAEKLGKPFVAILPSALGTVDFGLPSPLSYVPVFYSLLTDQMDFWGRVKNFLMFFEFFKKQWKIQSAYDDTIKEHFPDDSRPVLSHLLTKAELWFVNTDFAFDFARPLLPNTVCIGGLMSKPVKPVPQEFENFITKFGDSGFVLVSLGSMVSFIRSQEVLKEMNAAFAHLPQGVIWKYNPSHWPKDIKLAPNVKIVHWLPQNDLLGHPRIRLFVSHGGMNSIMEAIQHGVPMVGIPLFGDQHENLLRVKAKKFGVSIQLKQIKAETLALKMKQVIEDKRYKSAAEAASIIRRSQPLTPAQRLVGWINHILQTGGAAHLKPHAFQQPWYEQYLLDVFLFLLVVTLGTMWLCGKLLGLVARWLCGARKLKKA

SEQ ID NO: 2006 - protein, 150 aa, Mus musculus
AGHVCKSTEKQSMKQRYRECCRFFGDNGLTLKVFFTKAAPFGVLWTLTNYLYLHAIKKINATDVSVLFCCNKSFVFLLSWIVLRDRFMGVRIVAAILAIAGIVMMTYADGFHSHSVIGIALVVGSASMSALYKVLFKLLLGSAKFGEAAL

SEQ ID NO: 2007 - protein, 30 aa, Mus musculus
VLWTLTNYLYLHAIKKINATDVSVLFCCNK

SEQ ID NO: 2008 - protein, 380 aa, Helicobacter pylori
MHMQTKLIHGGISEDATTGAVSVPIYQTSTYRQDAIGHHKGYEYSRSGNPTRFALEELIADLEGGVKGFAFASGLAGIHAVFSLLQSGDHVLLGDDVYGGTFRLFNKVLVKNGLSCTIIDTSDLSQIKKAIKPNTKALYLETPSNPLLKITDLAQCASVAKDHGLLTIVDNTFATPYYQNPLLLGADIVVHSGTKYLGGHSDVVAGLVTTNNEALAQEIAFFQNAIGGVLGPQDSWLLQRGIKTLGLRMQAHQKNALCVAEFLEKHPKVERVYYPGLPTHPNYELAKKQMRGFSGMLSFTLKNDSEATPFVESLKLFILGESLGGVESLVGVPAFMTHACIPKTQREAAGIRDGLVRLSVGIEHEQDLLEDLEQAFAKIS

SEQ ID NO: 2009 - protein, 408 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 2010 - protein, 496 aa, Arabidopsis thaliana
MEFSCVHFLQNKTILVTGATGFLAKVFVEKILRVQPNVNKLYLVVRASDNEAATKRLRTEAFEKDLFKVLRDNLGDEKLNTLLSEKVVPVAGDIAMDHLGMKDSNLRERMQKEIDIVVNVAATTNFDERYDIGLGINTFGALNVLNFAKKCVKAQLLLHVSTAYVCGEKPGLLPEKPFVMEEICNENGLQLDINLERELMKQRLKELNEQGCSEEGTTFYMKELGMERAKLHGWPNTYVFTKSMGEMLLGNHKENLPLVIIRPTMITSTLFEPFPGWIEGLRTVDSVIIAYGKGVLKCFLVDVNSVCDMIPADMVANAMIAAAATHAGGSKVHMVYQVGSSHQNPIIYGEIREILFCYFTKNSLRSRNGSMITVSKMKLIPTLALFSLYMTIRYKLPVQLLKLVDIIYPSREGDEYKNKNRKIDMVMRLVKLYEPYVLFKGIFDDRNTKNLCAKQKEEDNRNSENFMFDFDPKIIKWKDYLINVHIPGLITHVLKK

SEQ ID NO: 2011 - protein, 1132 aa, Danio rerio
MSPARWDLPPELCCRPMAFVALTGLDVVYNAIHRAIWDAFCANRRADRVPISFKVLPGDHEYPKCRTKRTSYEWYIPKGILKTGWMNKHLNLVPALVVLFYELDWDDPQWKEKQSECATKVEIVRTSLQGRNTKVAVVLIQKKTPLPPGEDLVASERASALCGACDLSGKSLFVLPHTDHLVGYIIRLENAFYEHAQTYYYNEIRRVKSHKEFLNKTTHQLLFVRHQFKMGFFSELKQDTQNALKYYRTAYSLVHELRAHETNVLEIKTMAGFINYKICRLCFQHNTPLDAIAQFRKHIDLCKKKIGSAELAFEHTAWMSKQFQSFGDLFDEAIKLGLTAIQTQNPGFYYQQAAYYAQERKQQAGQLCSHEPGVGYPAPDPLETTSGALDFYGQRPWRQGHQSIDPPDSEKEKQGILALQVKERDVLHSELIIALLSNAVAQFKKYKCPRMKSHLMVQMGEEYYHAKDYTKALKLLDYVMCDYRTERWWSLLTSIVCTALKCSYLMGQVKDYITYSMELVGRASILSEEQKSRIEKNLIKVLMNEVPEPEPDCDPVSVKAAQSLWSDRVSLAGNNEFTIDVQDYVPFVQCKAKFLSPSFHIDEPVQLHVYVRADCPHPVRFSKLCVSLSNQEYNQYCLLEDAYKGKDILEPSSQENMCLVPGKTRKYCFNFVAKTEDVGKKIEITSVGLMLGRETGRYVYLNWRGGWGDAASSHESLQASRSFKRRTRLPEQHVDWDAVSVQSSTMIISRVPKISVQLTHEPPALTNEMFCMTVTIKSEEDTVGKDIKLTAGLKPGQDANLTQSTQITLNGSEVCDDSHPALLPDIPLGDLQPGQKIVKPLYIRCVSTGSRIFLFHVAYSVSATVEGKDITCKCHKDETVTVETVVPFEVAMKFVSSKFEHLERVYVDIPFLLMMDILSASPWPIELVESEVQLASSMTAIDQPQSQVEGVTLQTSECASECFLLKCPPVQNGTSTVASGHYIISWKRKSTFTETSVVRTVITLPHVMVENIPLYVHAEVPSFGRVRESLPVRYHLENRTGLVQDVEISVEPSDAFMFSGLKQVRMRILPGAEQEMLYNFYPLMAGYQVLPQLNINLLRFPNISSQLLRRFLPSRIFVKPQGRNGDASIEAA

SEQ ID NO: 2012 - protein, 311 aa, Bos taurus
MGVTAVLMLPLLLLGISGLLFIYQEVSRLWSKSVVQNKVVVITDAISGLGKECARVFHTGGARLVLCGKNWERLQSLYDALISVADPSKTFTPKLVLLDLSDISCVQDVAKEVLDCYGCVDILINNASVKVKGPAHKISLELDKKIMDANYFGPIILTKALLPDMISRRTGQIVLVNNIQGKLGIPFRTAYAASKHAALGFFDCLRAEVEEYDVVVSTVSPTFIRSYHVDPGQGNWEASIWKFFFRKLTYGTHPVDVAEEVMRTVRRKKQEVFLANPIPKAAVYIRTLFPELFFAVVACGVKEKLSVPEEG

SEQ ID NO: 2013 - protein, 259 aa, Bos taurus
MGVTAVLMLPLLLLGISGLLFIYQEVSRLWSKSVVQNKVVVITDAISGLGKECARVFHTGGARLVLCGKNWERLQSLYDALISVADPSKTFTPKLVLLDLSDISCVQDVAKEVLDCYGCVDILINNASVKVKGPAHKISLELDKKIMDANYFGPIILTKALLPDMISRRTGQIVLVNNIQGKLGIPFRTAFFFRKLTYGTHPVDVAEEVMRTVRRKKQEVFLANPIPKAAVYIRTLFPELFFAVVACGVKEKLSVPEEG

SEQ ID NO: 2014 - protein, 461 aa, Bos taurus
MNKPITASTYVRCLSLGLIRKLSDFIDPQEGWKKLAVAIKKPSGDDRYNQFHIRRFEALLQIGKSPTCELLFDWGTTNCTVGDLVDILVQNEFFAPASLLLPDAVPKNVNTLPSKVTVVAVQQKPKPLCGKDRTSVISDENPEQNYVLPDSSSPENTSLEFSDTRFHSFSFFELKDVTNNFDERPISVGGNKMGEGGFGVVYKGYVNNRTVAVKKLAAMVDISTEELKQQFDQEIKVMAKCQHENLVELLGFSSDGDDLCLVYVYMPNGSLLDRLSCLDGTPPLSWNMRCKIAQGAANGLSYLHENHHIHRDIKSANILLDEDFTAKISDFGLARASEKFAQTVMTSRIVGTTAYMAPEALRGEITPKSDIYSFGVVLLEIITGLPAVDEHREPQLLLDIKEEIEDEEKTIEDYVDRKMNDIDSTSIETMYSVASQCLHEKKNKRPDIKKVQQLLEEMTGS

SEQ ID NO: 2015 - protein, 496 aa, Arabidopsis thaliana
MAGTGLFAEILDGEVYKYYADGEWKTSSSGKSVAIMNPATRKTQYKVQACTQEEVNAVMELAKSAQKSWAKTPLWKRAELLHKAAAILKDNKAPMAESLVKEIAKPAKDSVTEVVRSGDLISYCAEEGVRILGEGKFLLSDSFPGNDRTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLDDADLDLVASNIIKGGFSYSGQRCTAVKVVLVMESVADELVEKVKAKVAKLTVGPPEENSDITAVVSESSANFIEGLVMDAKEKGATFCQEYKREGNLIWPLLLDNVRPDMRIAWEEPFGPVVPVLRINSVEEGINHCNASNFGLQGCVFTKDINKAILISDAMETGTVQINSAPARGPDHFPFQGLKDSGIGSQGVTNSINLMTKVKTTVINLPTPSYSMG

SEQ ID NO: 2016 - protein, 94 aa, Ovis aries
IWVMAAALCLPELLYSQVKEEHGTAICTVVYSSNESTKLKSAVLTLKVTLGFFLPFVVMACCYAIIIHTLIRAKKSSKHKALKVTITVLTVFVL

SEQ ID NO: 2017 - protein, 110 aa, Ovis aries
IWVMAAALCLPELLYSQVKEEHGTAICTVVYSSNESTKLKSAVLTLKVTLGFFLPFVVMACCYAIIIHTLIRAKKSSKHKALKVTITVLTVFVLSQFPHNCVLLVQTIDA

SEQ ID NO: 2018 - protein, 458 aa, Oryza sativa
MAAVEAEKVVAELRERCATPASLLRDVAAAMAGEMGAGLEKEGGSRVKMLLSYVDKLPTGREDGLFYGLDLGGTNFRVLKVHLGGSKKHVVNSESREVSIPPHLMSGTSSELFGFIAGELGKFVAEEEEGTDMPNGKKKELGFTFSFPVRQRSVASGTLVKWTKAFSIDDAVGEDVVAELQTAMVKQGLDMHVAALINDAVGTLAGARYYDEDVVAGVIFGTGTNAAYVEKANAIPKWEGELPNSGDMVINMEWGNFYSSHLPVTEYDEALDKESLNPGEQIYEKLTSGMYLGEIVRRVLLKLSLQSGIFGSIDNSKLKTCFHLRTPHISAMHHDETPDLKIVAEKLHQILEITHTSLEIRKMVVEICDIVARRAARLAAAGVAGILMKLGRNGGINNQRSVIAIDGGLFEHYTKFRECLESTLGELLGEEASKSVAVKHANDGSGIGAALIAASQSR

SEQ ID NO: 2019 - protein, 593 aa, Bombyx mori
MTKTVKWTPHVDCDKEASEVSFGDVNSHVKLDVKNLDKFHEIADRIEIEKTIPVDVNIHKDLYDSMINNKNESESKIMETANLKTEMKNLRKSSILQSKLKQFDKFNVSSNSAASESSTKSSMGSSRISDEDDLSSDDEMSEIMETFKLNLATPKKSEAKHTIDHIEVNNTKLNANPFKNLDGSKSVFVDKLTSPVLLVHTKRNNKVQPCSLLRDVPFGTSIHVVLRNMGIKHPTRLQTVSWGTILRGLSTFLISPPRSGKTMGYLPAVCRLVRDFRKESPDSCGPKCIIVCATSKSVSEVERISKMLLGLEDKVFACYSGMDNLSVTTALLNGCDLLICTPKSIVRLLQNDLSVDLRDLTTFVVDDCERISDVYSNEVKYVLYEIKNMLKNRVNKELKVQIVVASRIWCDFLELIVLKAPDSVVCIGAFQELILYSKISTTVDFLRPENKIANVLQFIDSVQGPKRTVVVCRADNEVKAVESSLRYSNRVVFACDNTMNIHDLYNLNVVWGDFEDPTLGPILVCCDSNLVHLNVTDASYLIHYSLPALFSTFCKRFSVLNDNYPSIFKNESRDLKVKVLMDESNVVTIAENP

SEQ ID NO: 2020 - protein, 210 aa, Caenorhabditis elegans [sequence omitted]

SEQ ID NO: 2021 - protein, 115 aa, Caenorhabditis elegans
LMDISMDLLYKRVYMVKNSRLNENVVGHITVCTVDALDYLKKELKIIHRDVKPSNILVDGTGAVKLCDFGICGQLEESFAKTHDAGCQPYLAPERITSSDKYDVRSDVWSLGITL

SEQ ID NO: 2022 - protein, 113 aa, Caenorhabditis elegans
LLYKRVYMVKNSRLNENVVGHITVCTVDALDYLKKELKIIHRDVKPSNILVDGTGAVKLCDFGICGQLEESFAKTHDAGCQPYLAPERITSSDKYDVRSDVWSLGITLYEIAT

SEQ ID NO: 2023 - protein, 164 aa, Caenorhabditis elegans
ASQSGMQVGEILRVASDENNAVPLVKKANIDALCIHLRGVLRFQKRLKLKKIVPHKILRFLNIKYSAYYVTFIYFVAKVAFLLNVILQSKLLNKYMLPHDRQQNFGFDMWKTIFYGSTNGNETWRENGVFPRVTLCDFETRDMGNVQMHTVQCVLLLNLFTEKI

SEQ ID NO: 2024 - protein, 145 aa, Caenorhabditis elegans
VPLVKKANIDALCIHLRGVLRFQKRLKLKKIVPHKILRFLNIKYSAYYVTFIYFVAKVAFLLNVILQSKLLNKYMLPHDRQQNFGFDMWKTIFYGSTNGNETWRENGVFPRVTLCDFETRDMGNVQMHTVQCVLLLNLFTEKIFV

SEQ ID NO: 2025 - protein, 110 aa, Caenorhabditis elegans
IVCIPENLLSFVKIRYPQVGNKLLKLISKCWKAPTPETMSHVETTRNQNLRTIAIVPASRRVPLTEFTCELYNQLSKHVKTLRLSSSVVENYFESEVITKKADYGLMHWL

SEQ ID NO: 2026 - protein, 128 aa, Caenorhabditis elegans
IVCIPENLLSFVKIRYPQVGNKLLKLISKCWKAPTPETMSHVETTRNQNLRTIAIVPASRRVPLTEFTCELYNQLSKHVKTLRLSSSVVENYFESEVITKKADYGLMHWLNVQEIAYSLVLYQCDFHK

SEQ ID NO: 2027 - protein, 958 aa, Caenorhabditis elegans
MSKAELAVLERRLRPIYDSLDSQQFKKALSDCDKVLKKHPNTSAAKVLKALTLIRLEKLADATEILEALDVPGAHHDELTLQAFVHCYRDSNQHMKVVTLYERIIQVDPSEHNLTQLFMAYSREKMYKEQQKIGMRLYKDFGNAPYYFWSVMSLIMQAQENPELGKKMLLPLADKMCQTQVEKSGYTEGSSAELDLQLLILEGQEKWKECAAFLDRPQASVLPMAPYNLVEKGMDFLMKDKQYKRVDQLAMEAVTKMPDNWNLWKIITESTICQIEQCLESDNKENIELAHNFVKRLGLLIEKVQKQVGYKSRAPFIATFFAYKQIGKLTKQIPDMDDMTSIFGEQVDKMLEYAKNFYKKPVCFADLQMFFCDLTSEQKSNFLKGIDLWIGEVSAKDDVEGDESKVWAIILTERCRRALGEYEKMDAAGHRSLFQQCIAQIAAPERTEHAQGVLCNLTVSHLWDAYRKENDLTKFYEMILLLEFVAASNKTDPMCKLALIRAYSALCATGRISALVKTLDIKVIQMDTLGHLTFPVYETSGRFNLAIIQNTQLSLMYEQAEKEIQDCIAQAYRNGKFSAIPRMTAASKHMKLSAQKTACDVMNRYLSSLFVLDDVDQITVTLWGDEDPIGEKRIDWKQLIDTRDFNAIPYTETEEYEALLDDMKKRTFKELIDISELRSTLCRALGAVGRVTHENMEPRLARLQLKMTVMEFKQHLEYCCREYPSFLIPSKLAQSPAPHHLSQWVHSGGLQMVLEYLEAAVKLVDILDSGEHPEKSLVGTRTEMATKLIKLIEIPPKRKEGEKLPPFWIVDPIIKSSRALQTIAAIQVVLRLIEKVVLKLVKNVPTAVPEPVGKGKGKKDKKAAEEAMTKALDECKAVVFLEHIRAMHVELRSAGNFLHTYLGQMLALEDEYIPSNIGEDLGGAKAALEGMHNPVASRLQRSFLNTCEDMHTTIKLRF

SEQ ID NO: 2028 - protein, 38 aa, Caenorhabditis elegans
DDKEPKSCPQQTVKYIKILTPHVILVSVLIGYLCLGAW

SEQ ID NO: 2029 - protein, 33 aa, Caenorhabditis elegans
KSCPQQTVKYIKILTPHVILVSVLIGYLCLGAW

SEQ ID NO: 2030 - protein, 38 aa, Caenorhabditis elegans; identical to SEQ ID NO: 2028

SEQ ID NO: 2031 - protein, 33 aa, Caenorhabditis elegans; identical to SEQ ID NO: 2029

SEQ ID NO: 2032 - protein, 523 aa, Caenorhabditis elegans
MHYSQMRWMFFCLTALLHGSFIVNAAKILVYCPSISKSHVLLCSKYADLLHNAGHDTVLFIPSYSKLLDNYDGAKHAKVWRLHNVTEAYDTKLGTLANVMENSHIGFIDRLTFDADFWIDMCADLLGKLPEMQHIIDYKFDLVIYNEIDPCTPAIVRLFNIPKTVLLSSEAIMDKVAWNLGLPTLPSYVPSVEENPNHDRMSFFERMSNVYKFFQSIVVHYLQDIHVLNLFRKEVSSDFPSIAEIIRNVSLVLVNTDEIFDLPRSYSSKFVYVGMLEAGKDENVTLPKKQDDYFKKGKSGSVFVSFGTVTPFRSLPERIQLSILNAIQKLPDYHFVVKTTADDESSAQFFSTVQNVDLVDWVPQKAVLRHANLKLFVSHGGMNSVLETMYYGVPMVIMPVFTDQFRNGRNVERRGAGKMVLRETVVKETFFDAIHSVLEEKSYSSSVKRISHLMKNKPFTSEERVTKWIDFVLKYETSEHFDLESNNLSIIEHNHLDLFFYLCIISLLNFVVYRKIFKRKSQS

SEQ ID NO: 2033 - protein, 499 aa, Caenorhabditis elegans
MAKLSKENLLLLFTVLGVVVGIGLGFSLRDPSKAWSKRHLSYLRFPGDLFVQMLKMLILPMIMSSIITSLASLDSGTAGRLGMVSMIYYTLTTFFAVFLGIVLVSVIKPGKWTTTNIEDLVGHVKTTPCVATAVDTIIDLMKSCFPENLIEATFRSQKICLKFFNGTTEIPPEIAMTMSPEQRAQFTEVPEKIVSDGMNILGLVVFSVALGIVIGVIGEDGKPMKNFFKSLEACSMKLIGWVIIYSPVGITFLIAAQIVGMKDPGQELHRLMGYVITVILGLLIHAFVVIPLLCVVLARRNPIKFVGGMAQALLTALATSSSSATLPLSIKCCEENNKVDPRVTRFVLPLGATINMDGTALYEAVAAIYISQCYGNDLSLGEVVLVSLTATLASIGAAGIPQAGIVTMIMVLIAIGLPTNLFILIFPVDFMLDRLRTTVNVHGDSIATAVIERLCEDQLQKGGHHLDTNDQGYSMLSTNASPDPKRITIGNNCENSHML

SEQ ID NO: 2034 - protein, 629 aa, Caenorhabditis elegans
MVLSCRVVDCGGLKLKENQTLLLLVSTIHNSSEVGKLSIDAEEKRSKEWLEMPCAEGMLSLKLTLWQDLLKGINSVFHGQVRVDVDENWKSGPAKWFYLRSKANEDGEGGEDGGDIGDATVKVTYQIDHILRMQVYKPLLDLLFLAGDVQPLTASLVAVIEALPKVELGPVSRSLVELMAQSDRIRPVLSSLYVNSILKCQDENTLFRGQSLSGKMLFEILTTYGKMYLITTLKPVVDKIYKERKNCEVDPARVAVGASLEKNRNNLLVYFQMLFERVTTSSTNCPHLIKQLLYDLRNVVGTHSSRSGVQRLAVSSFVIMRFFAAAILNPKAFEIRKDQPDLRVSRTLLLLSKLLQRLSNCSVSEGPLSSKEIWLNGVFETVTSEQHKSVMASFLDNISLVGDRSEPQKCTVFKFGNLQQVDRSRLAWKKVLHYKKRYVQLTNTHLIWQKDVQCAPKGTVPLSDIKFVNVDNKNIITIVCETMQLQFEAPGGVEATDWLNAIERQRNRAAHEIAETPGEHFFVDAERHVDKIHTLLYKYRETMIEWRDQLQSNVELDEKTAPELLKASYVVEEERQSHKDSLIATLCSTIDVTDAIQLAHTEYEKENKVSRRIDAIITAKKRQKSFSVK

SEQ ID NO: 2035 - protein, 134 aa, Caenorhabditis elegans
CVGISFLTILVFYLPSDSGEKVTLCISILVALTIFFLLLTEIIPATSITLPLIGKYLLFTMVMVTLSVVVTVISLNLHFRTPTTHLMPNWVKKVFLKWLPKLLFMRRPIDDYEEKFDDKKKPKDGKIALSVHAH

SEQ ID NO: 2036 - protein, 161 aa, Caenorhabditis elegans
SDSGEKVTLCISILVALTIFFLLLTEIIPATSITLPLIGKYLLFTMVMVTLSVVVTVISLNLHFRTPTTHLMPNWVKKVFLKWLPKLLFMRRPIDDYEEKFDDKKKPKDGKIALSVHAHRVSNVGNNIRNATIDDTIQKMYYSPPVVKAFENICFIAELLK

SEQ ID NO: 2037 - protein, 250 aa, Caenorhabditis elegans
MSAAHKNLLAVWAKEPKDLVAVEKALNELTKVLSASSDLNDKQSALASKDLYEISVLLAILKHDFETFDDYINQMHTYYTMAPENSENKHLMTGLHLMFLLAANRLSDFHMLLEQIPQKEQTSNAYISTPVRIEQSLMEGAYNKVVLTEKNIPSPFYTIFIRIMLDTIRREIATSIEKSFKVLTAKDATVMLLFDNDEQMKKFGQERKWHLDGERYVFEIEVAQEKPVNLDTVRVATQTLFYAKQLEQIV

SEQ ID NO: 2038 - protein, 912 aa, Dictyostelium discoideum
MSALTQSGSIEKPCTILINYDKGDPPQVNEFKQNFEHGTTEQKIETLKKVILYTINGEPIPQLLMPIILYVMPSNDHTIKKLLLIYWEVIEKTHLGKLKSEMILVCNSLLNDLNHPNEFVRGSTLRFLCKLREAEVLEPLVPSVRSNLENRHAYCRRNAVLAIYNIYSHFDYLIPDAPELIYNFLLQEKDASCKRNAFIMLFNCAPEKAVEYLSSVLDEVPSFGDMLQFIVVELIRKVCKTSPSERSKYIKCIFTLLNSSSPAVKYESAGTLLSLSSAPTAVRGAASAYIDLLCNESDNNVKMIVLDKLIEIKKNHSKIMEELVMDILRALSSPNIDICKKVLNIVLDSVTPKNIDEIILFLKKEINKTQSKEFDKGLEYRHILIRTIHVSSLKYPEVLGNVVPLLMEYLGDSYLPSAVDVVIFLREVVETYPSLRELIIKKLIENLSSIKVSKVYRVAVWVIAEYVTCLEDLQYAMTSITNDLEELLKPKQTEEVILETKAKVKIEKVSIQKLIADGDWYLASCISSSLTKLFFRAEQLNIDNADSNKLKAQVMMIISVLINLSKASQVSTSKSAYERMLSCIQVLIDSNATIKKIWLQDCRDSFANYLKYLLIKQSENKKKTEKEVLVKPNNIINIRQLKSKKAFGPVDTEDDLIKAVGNTGEANKDQNEYSKISQLSGFSDPIYVEAYVRVHQYDIVLDISVFNQTNDTLQNVTLELVTLGDLKICERVPPFTMAPREKTSAKASIKVSSTDNGVIMGTIAFDIAGSVSSMSDKNCVILNELHIDVIDYILPANHQYTDVLFRNHWLEFEWENKIPVNTNITDLVKYVHHISKVTNMGILTPEVHLSNDTGILSANLCAKSVFGEDALANICIEKQADGKISGYIRIRAKVQSIAVTLGEKIGNMGMKA

SEQ ID NO: 2039 - protein, 140 aa, Drosophila melanogaster
LLVDALFRSGVKINPEHKPKYMFLLAYASAVIDQPAKKRPMTERMLNKEELKSTIQAIEKAHTICNVDQGSTELIAELQTLYNCIKYPVVGVGVIRWIENVVMEPSYFKLSTDSCPTHLAVLDEVAAVHPTLQQQILFLL

SEQ ID NO: 2040 - protein, 88 aa, Drosophila melanogaster
ITGLIPFVGKASSQLHLKDIRGSTVAVDTYCWLHKGVFGCAEKLARGEDTDVYIQYCLKYVNMLLSYDIKPILVFDGQHLPAKALTEK

SEQ ID NO: 2041 - protein, 73 aa, Drosophila melanogaster
TGLIPFVGKASSQLHLKDIRGSTVAVDTYCWLHKGVFGCAEKLARGEDTDVYIQYCLKYVNMLLSYDIKPILV

SEQ ID NO: 2042 - protein, 96 aa, Entamoeba histolytica
MRAIIFVLIFAIAFAATREGAILCNLCKDTVKLVENLLTVDGAQAVRQYIDNLCGKASGFLGTLCEKILSFGVDELVKLIENHVDPVVVCEKIHAC

SEQ ID NO: 2043 - protein, 101 aa, Entamoeba histolytica
MKLFVLLCVFVLCLASQEKQQDREIPVLCPVCTSLVGKLIDLVLGGAVDKVTDYLETLCAKADGLVETLCTKIVSYGIDKLIEKILEGGSAKLICGLIHAC

SEQ ID NO: 2044 - protein, 33 aa, Manduca sexta
VQVLPLLMMHGWPSSSKEFDKVIPILTTPKHEY

SEQ ID NO: 2045 - protein, 41 aa, Manduca sexta
LPLLMMHGWPSSSKEFDKVIPILTTPKHEYNIVFEVVAVDL

SEQ ID NO: 2046 - protein, 492 aa, Onchocerca volvulus
MVSWIRKNLLLVLTVSSVVLGALCGFLLRGLQLSPQNIMYISFPGELLMHMLKMMILPLIMSSLISGLAQLDARQSGKLGSLAVTYYMFTTAVAVVTGIFLVLVIHPGDPTIKKEIGTGTEGKTVSTVDTLLDLLRNMFPENVVQATFQQVQTKYIKVRPKVVKNNDSATLAALNNGSLDYVKASVEYTSGMNVLGVIVFCIAIGISLSQLGQEAHVMVQFFVIMDKVIMKLVMTVMWYSPFGILCLIMGKILEIHDLADTARMLAMYMVTVLSGLAIHSLISLPLIFFVTTKKNPYVFMRGLFQAWITGLGTASSSDTLPITYICLEENLGVDRRVTRFVLPVGATINMDGTALYEAVAAIFIAQINGVHLSFGQVVTVSLTATLASIGAASVPSAGLVTMLLVLTAVGLPVKDVSLIVAVDWLLDRIRTSINVLGDAMGAGIVYHYSKADLDAHDRLAATTRSHSIAMNDEKRQLAVYNSLPTDDEKHTH

SEQ ID NO: 2047 - protein, 210 aa, Caenorhabditis elegans
MFFSKAGKAAVEWAKGSKVPYKEFALTLEKIEELSGKKKVDELAQFFTKVLDFSPDDLTACVYMSVNQLGPSYEGLELGVAENSLIKAVAKATGRTEGKIKEDLRAKGDLGTVAQQSRSNQKMLAVPKALTVPTVFNKLTEIAKLSGTSAMNKKVDAISALLIACQGIEARFLVRMLAGKMRIGLGEQSVLSALGHAFTLSKITDQKRMP

SEQ ID NO: 2048 - protein, 404 aa, Caenorhabditis elegans
MSKNKFLFTSESVSEGHPDKMCDQISDAVLDAHLAQDPHAKVACETVTKTGMIMLCGEITSKAVVDYQVLVRNVIKKIGYDDSSKGFDYKTCNVLVALEQQSPEIAAGVHVDKDIADVGAGDQGIMFGYATDETEEAMPLTLLLSHKLNYKLHELRRSGELEWVRPDSKTQVTIEYSSEGGACVPLRVHTVVISTQHSPDISLEDLRKELIEKVIKVVIPGNLIDNDTVYHLNPCGSFVVGGPMGDAGLTGRKIIVDTYGGWGAHGGGAFSGKDPTKVDRSAAYAARWVAKSLVKAGLCRRCLVQVSYAIGVAKPLSVMVFSFGTSALNEAELLKIVNDNFDLRPGMIIKNLDLKRAIYEPTAENGHFGHNDFPWEQARKLKIDKDLRAKSKGPALVDAIGIAH

SEQ ID NO: 2049 - protein, 353 aa, Caenorhabditis elegans
MIMLCGEITSKAVVDYQVLVRNVIKKIGYDDSSKGFDYKTCNVLVALEQQSPEIAAGVHVDKDIADVGAGDQGIMFGYATDETEEAMPLTLLLSHKLNYKLHELRRSGELEWVRPDSKTQVTIEYSSEGGACVPLRVHTVVISTQHSPDISLEDLRKELIEKVIKVVIPGNLIDNDTVYHLNPCGSFVVGGPMGDAGLTGRKIIVDTYGGWGAHGGGAFSGKDPTKVDRSAAYAARWVAKSLVKAGLCRRCLVQVSYAIGVAKPLSVMVFSFGTSALNEAELLKIVNDNFDLRPGMIIKNLDLKRAIYEPTAENGHFGHNDFPWEQARKLKIDKDLRAKSKGPALVDAIGIAH

SEQ ID NO: 2050 - protein, 434 aa, Caenorhabditis elegans
MPITKIHARQIYDSRGNPTVEVDLFTEKGVFRAAVPSGASTGVHEALELRDGDKAVHLGKGVLKAVSNINEKIAPALIAKGFDVTAQKDIDDFMMALDGSENKGNLGANAILGVSLAVAKAGAVHKGLPLYKYIAELAGTGKVVLPVPAFNVINGGSHAGNKLAMQEFMILPVGASSFAEAMRMGSEVYHHLKAEIKKRYGLDATAVGDEGGFAPNIQDNKEGLDLLNTAIDKAGYTGKISIGMDVAASEFFKDGKYDLDFKNPASDSSKWLSGEQLTELYQSFIKEYPVVSIEDAFDQDDWDNWGKFHGATSIQLVGDDLTVTNPKRIQTAIDKKSCNCLLLKVNQIGSVTESIEAAKLSRANGWGVMVSHRSGETEDTFIADLVVGLATGQIKTGAPCRSERLAKYNQLLRIEEELGADAVYAGHNFRNPQV

SEQ ID NO: 2051 - protein, 337 aa, Caenorhabditis elegans
MPITKIHARQIYDSRGNPTVEVDLFTEKGVFRAAVPSGASTGVHEALELRDGDKAVHLGKGVLKAVSNINEKIAPALIAKGFDVTAQKDIDDFMMALDGSENKGNLGANAILGVSLAVAKAGAVHKGLPLYKYIAELAGTGKISIGMDVAASEFFKDGKYDLDFKNPASDSSKWLSGEQLTELYQSFIKEYPVVSIEDAFDQDDWDNWGKFHGATSIQLVGDDLTVTNPKRIQTAIDKKSCNCLLLKVNQIGSVTESIEAAKLSRANGWGVMVSHRSGETEDTFIADLVVGLATGQIKTGAPCRSERLAKYNQLLRIEEELGADAVYAGHNFRNPQV

SEQ ID NO: 2052 - protein, 465 aa, Caenorhabditis elegans
MFVPFTSAAHSLTSLIRGGGQPSKSNLSGQRMPITKIHARQIYDSRGNPTVEVDLFTEKGVFRAAVPSGASTGVHEALELRDGDKAVHLGKGVLKAVSNINEKIAPALIAKGFDVTAQKDIDDFMMALDGSENKGNLGANAILGVSLAVAKAGAVHKGLPLYKYIAELAGTGKVVLPVPAFNVINGGSHAGNKLAMQEFMILPVGASSFAEAMRMGSEVYHHLKAEIKKRYGLDATAVGDEGGFAPNIQDNKEGLDLLNTAIDKAGYTGKISIGMDVAASEFFKDGKYDLDFKNPASDSSKWLSGEQLTELYQSFIKEYPVVSIEDAFDQDDWDNWGKFHGATSIQLVGDDLTVTNPKRIQTAIDKKSCNCLLLKVNQIGSVTESIEAAKLSRANGWGVMVSHRSGETEDTFIADLVVGLATGQIKTGAPCRSERLAKYNQLLRIEEELGADAVYAGHNFRNPQV

SEQ ID NO: 2053 - protein, 432 aa, Drosophila melanogaster
MSKPSYKVADISLAEWGRKAIIIAENEMPGLMACRKKYGPSKPLKGARITGCLHMTVQTAVLIETLVELGAQVQWSSCNIFSTQDNAAAAIAATGVPVYAWKGETDEEYMWCIEQTLVFPDGQPLNMILDDGGDLTNLVHEKFPQYLKNIKGLSEETTTGVHNLYKMFKEGRLGVPAINVNDSVTKSKFDNLYGCRESLIDGIKRATDVMIAGKVCCVAGYGDVGKGCAQALKGFGGRVIVTEVDPINALQAAMEGYEVTTMEEASKEASIFVTTTGCRDIITSVHLQQMPDDAIVCNIGHFDIEIDVDWLNANAKEKVNVKPQVDRYTMQSGKHIILLAEGRLVNLGCAHGHPSFVMSNSFTNQVLAQIELWTKSDKYAVGVHVLPKILDEEVASLHLEKLGVKLTKLTEKQATYLGVSQTGPFKPDHYRY

SEQ ID NO: 2054 - protein, 86 aa, Musca domestica
LYVDEKNDPMSANLFVMEGQSWRTLRMKLAPSFSSGKLKGMFETVDDVAAKLLNHLNERLKDGQSHVLEIKSILTTYAVDIIGSVI

SEQ ID NO: 2055 - protein, 63 aa, Musca domestica
LLLIVVTTLYIFAKLHYTKWERLGFESDKATIPLGSMAKVFHKERPFGLVMSDIYDKCHEKVV

SEQ ID NO: 2056 - protein, 316 aa, Plasmodium falciparum
MAPKAKIVLVGSGMIGGVMATLIVQKNLGDVVLFDIVKNMPHGKALDTSHTNVMAYSNCKVSGSNTYDDLAGADVVIVTAGFTKAPGKSDKEWNRDDLLPLNNKIMIEIGGHIKKNCPNAFIIVVTNPVDVMVQLLHQHSGVPKNKIIGLGGVLDTSRLKYYISQKLNVCPRDVNAHIVGAHGNKMVLLKRYITVGGIPLQEFINNKLISDAELEAIFDRTVNTALEIVNLHASPYVAPAAAIIEMAESYLKDLKKVLICSTLLEGQYGHSDIFGGTPVVLGANGVEQVIELQLNSEEKAKFDEAIAETKRMKALA

SEQ ID NO: 2057 - protein, 545 aa, Photuris pennsylvanica [sequence omitted]

SEQ ID NO: 2058 - protein, 434 aa, Schistosoma mansoni
MSILTIHARQIFDSRGNPTVEVDLKTSKGLFRAAVPSGASTGVHEALELRDTNSKAYMKKGVLTAVSNVNKIIAPALINKNIPVTNQAAIDKYMIDLDGTENKEKLGANAILGVSLAVCKAGAAEAGLPLYRYIARLAGHEDVIMPVPAFNVINGGSHAGNKLAMQEFMILPTGASSFTEAMQIGTEVYHNLKAVIKREYGLDACNVGDEGGFAPNIQDNMKGLQLLEEAIKIAGYTGKVEIGMDCAASEFHKNGKYDLDFKNPHSAESTWLSPDAMANMYKQMISKFPIVSIEDPFDQDDWETWPKLTSSTNIQIVGDDLTVTNPKRIKQAIASKACNCLLLKVNQIGSLTESIEACKLAQDSGWGVMVSHRSGETEDTFIADLVVGLCTGQIKTGAPCRSDRLAKYNQLLRIEEELGTAAKYAGKNFRHPKV

SEQ ID NO: 2059 - protein, 333 aa, Caenorhabditis elegans
MASTIKEVFAEIAAPVENSHGKVTVVGVGQVGMACAYSILQQNLANELCLVDVVADKLKGEMMDLQHGLAFTRHCTVKADTDYSITAGSKLCVVTAGARQREGETRLSLVQRNVEIFKGIIPQLVKYSPDTCILVVSNPVDVLTYVTWKLSGLPRERVFGSGTNLDSARFRFLLSEKLNIAPSSCHGWIIGEHGDSSVAVWSGVNVAGVTLHEIKPDIGEKTDNEHWEAEIHKKVVDSAYEIIKLKGYTSWAIGLSVAKIAQGIFSNSRNVFALSTNVKGFHGINDDVYLSLPVVLGSAGLTHVVKQQLTEAEVQKLHNSAKALLEVQNGIVM

SEQ ID NO: 2060 - protein, 693 aa, Bos taurus
MAPWPELENSQPTSEKYTVKADGEQSAKPEKAKETEKDDTGTPITKIELVPSHSTATLIEEPTEVEDPWDLPELKDTGLKWSERDTKGKILCVFQGIGKFILLLVFLYFFVCSLDVLSSAFQLVGGKVAGKFFNNNSIMSNPLAGMVIGVLVTVLVQSSSTSTSIVVSMVASSLLPVHAAIPIIMGANIGTSITNTIVALMQAGDRKEFRRAFAGATVHDFFNWLSVLVLLPLEAATGYLERLTNLVVESFHFKNGEEAPELLKVITDPFTKLIIQLDKSILNQIAMNDESVQNKSMIKIWCKTFTNVTERNVTVPSPENCTSPSLCWTDGLYTWTIKNVTYKENIAKCQHIFVNFNLSDAIVGTILLITSLLILCTCLILIVKLLGSVLRGQVAAVIKKTINTDFPYPFSWVTGYLAILVGAGMTFIVQSSSVFTSAMTPLIGIGVISIQRAYPLTLGANIGTTTTAILAALASPGSTLKSSLQIALCHFFFNISGIILWYPIPFTRLPIRLAKGLGNISSKYRWFAIVYLIVFFLLIPLAVFGLSLIGWPVLVGVASPIVLVILLVVVLKILQSFCPGSLPQKLRSWDFLPFWMRSLEPWDKLITSLTSCFQMRCCCCCRVCCRLCCGLCGCSKCCRCTKCSEDLEEGKDEPVKSPEAFNNLAMDKEAQDGVTKSEVDASGTKIVSSVTAL

SEQ ID NO: 2061 - protein, 54 aa, Bos taurus
AVDRYLAITSPFKYQCLLTKNKARVVILMVWIVSGLTSFLPIQMHWYRASHKEA

SEQ ID NO: 2062 - protein, 30 aa, Bos taurus
KALKTLGIIMGTFTLCWLPFFIVNIVHVIK

SEQ ID NO: 2063 - protein, 66 aa, Bos taurus
KKTQTWIITCIYLQLLLFNPLVHTQGICSNRVTDDVKDVTKLVANLPKDYMITLKYVPGMDVLPSH

SEQ ID NO: 2064 - protein, 134 aa, Bos taurus
ITCIYLQLLLFNPLVHTQGICSNRVTDDVKDVTKLVANLPKDYMITLKYVPGMDVLPSHCWISEMVEQLSVSLTDLLDKFSNISEGLSNYCIIDKLVKIVDDLVECMEEHSSENVKKSSKSPEPRQFTPEKFFG

SEQ ID NO: 2065 - protein, 66 aa, Bos taurus; identical to SEQ ID NO: 2063

SEQ ID NO: 2066 - protein, 134 aa, Bos taurus; identical to SEQ ID NO: 2064

SEQ ID NO: 2067 - protein, 134 aa, Bos taurus
GPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQLVLVDDWIRLQISHEAAACITALRAAMEALVVEVTK

SEQ ID NO: 2068 - protein, 116 aa, Bos taurus
LDVVISLLAFGVYPNVCYHKEKRKILTTEGRNALIHKSSVNCPFSSQDMKYPSPFFVFGEKIRTRAISAKGMTLVTPLQLLLFASKKVQSDGQLVLVDDWIRLQISHEAAACITAL

SEQ ID NO: 2069 - protein, 147 aa, Cebus albifrons
MVHFTADEKVAITSLWSKMNVEEAGGEALGRLLVVYPWTQRFFDNFGNLSSPSAILGNPKVKAHGKKVLTSFGDAIKNMDNLKTTFAKLSELHCDKLHVDPENFRLLGNVMVIILATHFGKEFTPEVQAAWQKLVSAVAIALGHKYH

SEQ ID NO: 2070 - protein, 147 aa, Cheirogaleus medius
MVHFTAEEKSTILSLWGKVNVEEAGGEALGRLLVVYPWTQRFFDSFGNLSSASAIMGNPKVKAHGKKVLTSFGEAVKNMDNLKGAFAKLSELHCDKLHVDPENFKLLGNVMVIILATHFGKEFTPDVQAAWQKLVSGVATALAHKYH

SEQ ID NO: 2071 - protein, 147 aa, Daubentonia madagascariensis
MVHFTAEEKATIMSLWGKVNVEEAGGEALGRLLVVYPWTQRFFDNFGNLSSASAIMGNPKVKAHGKKVLTSFGDAVKNMDNLKGAFAKLSELHCDKLHVDPENFRLLGNVMVIILATHFGKEFTPDVQAAWQKLVSGVATALAHKYH

SEQ ID NO: 2072 - protein, 147 aa, Microcebus murinus
MVHFTAEEKSTILSLWGKVNVEEAGGEALGRLLVVYPWTQRFFDSFGNLSSASAIMGNPKVKAHGKKVLTSFGEAVKNLDNLKPAFAKLSELHCDKLHVDPENFKLLGNVMVIILATHFGKEFTPDVQAAWQKLVSGVATALAHKYH

SEQ ID NO: 2073 - protein, 147 aa, Macaca mulatta
MVHFTAEEKAAVTSLWSKMNVEETGGEALGRLLVVYPWTQRFFDSFGNLSSPSAILGNPKVKAHGKKVLTSFGDAIKNMDNLKITFAKLSELHCDKLHVDPENFKLLGNVMVIILATHFGKEFTPEVQAAWQKLVSAVAIALAHKYH

SEQ ID NO: 2074 - protein, 73 aa, Macaca mulatta
VLTSFGDAIKNMDNLKITFAKLSELHCDKLHVDPENFKLLGNVMVIILATHFGKEFTPEVQAAWQKLVSAVAI

SEQ ID NO: 2075 - protein, 76 aa, Macaca mulatta
VLTSFGDAIKNMDNLKITFAKLSELHCDKLHVDPENFKLLGNVMVIILATHFGKEFTPEVQAAWQKLVSAVAIALA

SEQ ID NO: 2076 - protein, 147 aa, Pan paniscus
MVHFTAEEKAAVTSLWSKMNVEEAGGEALGRLLIVYPWTQRFFDSFGNLSSPSAILGNPKVKAHGKKVLTSFGDAIKNMDNLKPAFAKLSELHCDKLHVDPENFKLLGNVMVIILATHFGKEFTPEVQAAWQKLVSAVAIALAHKYH

SEQ ID NO: 2077 - protein, 147 aa, Pan paniscus
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFRLLGNVLVTVLAIHFGKEFTPEVQASWQKMVTAVASALSSRYH

SEQ ID NO: 2078 - protein, 147 aa, Sminthopsis crassicaudata
MVHLSAEEKGHINAIWSKVSVDQTGAEALGRLLIVYPWTSRFFDHFGDLSSAKGVMGNAKVQGHGAKVLTSFGDAVKNMDNLKGTFAKLSELHCDKLHVDPENFRLLGNILVICLAEHFGKDFTPEVQAAWQKLVAGVATALAHKYH

SEQ ID NO: 2079 - protein, 46 aa, Sus scrofa
LAITSPFKYQCLLTKNKARVVILMVWVVSGLISFLPIKMHWYQATH

SEQ ID NO: 2080 - protein, 53 aa, Sus scrofa
TSPFKYQCLLTKNKARVVILMVWVVSGLISFLPIKMHWYQATHREALNCYAEE

SEQ ID NO: 2081 - protein, 672 aa, Xenopus tropicalis
MSDKGELMEEIMEAKVMWYPDSKKITQMDQFRNRVNRNLGLRLANYNELYQWSVEFYPEFWAEFWDFSGIVYSKTYDEVIDRSKGIADVPEWFKGSRLNYAENLLKHKENDKIALYSAREGKENIEKVTFAELRRDVALFAAAMRKMGIKTGDRVAGYLPNCIQTVEAMLAAASIGAIWSATSPDFGVNGVLDRFSQIQPKLILSVESVIYNGKEHCHLEKLQHVVKGLPDLKKVVVIPYVLPKEKIDISKIPNSMFLDEFLATGKVGDQSPQLEFEQLPFNHPLYIMYSSGTTGAPKCMVHSAGGTLIKHLTEHILHGSTTSSDVIMYYTTAGWMMWNWLITAVATGASLVLYDGSPLVPSLNVLWDLVDRLGITILGTGAKWLAVLEDKGLKPCNTHSLQTLHTILSTGSPLKPQSYEYVYKHIKSNVLLGSVSGGTDIIACFMGQNVSVPVYKGEIQARHLGMAIEAWNEEGEAVLGESGELVCLKPLPSQPTHFWNDENGSKYQKAYFAKFPGVWAHGDYCKINPKTGGIVMLGRSDGTLNPNGVRFGSSEIYNIVEAFVEVSDSLCVPQYNKDGDERVILFLKMADKFEFSKELLKRIKDAIRVALSARHVPALILETKDIPYTISGKKVEVAVKQVIAGKEVPHRGAFSNPQSLDLYRNIPELQNF

SEQ ID NO: 2082 - protein, 150 aa, Xenopus tropicalis
TVEAMLAAASIGAIWSATSPDFGVNGVLDRFSQIQPKLILSVESVIYNGKEHCHLEKLQHVVKGLPDLKKVVVIPYVLPKEKIDISKIPNSMFLDEFLATGKVGDQSPQLEFEQLPFNHPLYIMYSSGTTGAPKCMVHSAGGTLIKHLTE

SEQ ID NO: 2083 - protein, 194 aa, Xenopus tropicalis
KLILSVESVIYNGKEHCHLEKLQHVVKGLPDLKKVVVIPYVLPKEKIDISKIPNSMFLDEFLATGKVGDQSPQLEFEQLPFNHPLYIMYSSGTTGAPKCMVHSAGGTLIKHLTEHILHGSTTSSDVIMYYTTAGWMMWNWLITAVATGASLVLYDGSPLVPSLNVLWDLVDRLGITILGTGAKWLAVLEDKGLK

SEQ ID NO: 2084 - protein, 259 aa, Xenopus tropicalis
MALFSVPPPVTVILLDIEGTTTPITFVKDVLFPYVKENIKKYLLEHWQEKECQEDVTQLQKQAEKDSHLDGFVPIPSGVSDNTTEHMIQAVVDNVYWQMSFDRKTTALKQLQGHMWRSAYISGQLKGEVYEDVVPSIRQWRELGIKLYIYSSGSIDAQKLLFGYSIEGDLLKLLDGHFDTNIGHKVESKSYRNIADNIGCLPENILFLTDVVKEALAAEKAGLHVAVVVRPGNAALTDEDKSNCCCITSFHQIHFPSQK

SEQ ID NO: 2085 - protein, 139 aa, Xenopus tropicalis
KFLKALGIFESYDLLKVVHIVQFIFILKLGSTCFMVLFQKPFSSGKSITKRQWVSIVKHAFVSCIISLLWFFGLTLCGPLRTLLLFEHSDIVVISLLTVLFTGSGGGPSKTRGAAFFIIAVICLLLFDNDDLMAKIAEH

SEQ ID NO: 2086 - protein, 68 aa, Xenopus tropicalis
LKVVHIVQFIFILKLGSTCFMVLFQKPFSSGKSITKRQWVSIVKHAFVSCIISLLWFFGLTLCGPLRT

SEQ ID NO: 2087 - protein, 356 aa, Xenopus tropicalis
MAPMGIRLSPLGIGVFCLLGLGVLYHVYSGFLTGKFSAFLLGDRAEDPGPGEDTVDLRELLAVSVRAAELGGLEVKKVRESNSLNEKAKGKTMEGADDKMTSGDVLSNKKMYHLIKNAFPALKVNTEEKVEADDEDAVSWDRNIPDDIKEQIKTKHVASESITMWIDPLDATQEYTENLVNYVTTMVCVAVNGKPVIGVIHKPFTGFTAWAMLDGGSSIKKRNSYNEKTPTFIVSRSHSGEVKEVTRQTFGNKTEIISAGGAGYKVLSLLDVTDDKQETADVYIHVTYIKKWDICAGNAILNALGGQMTTLKGEEIMYTGSELNKGGLLASIGMDHGVLVEKLSEKLQVNAKKPAK

SEQ ID NO: 2088 - protein, 523 aa, Xenopus tropicalis
MLNVPSQSFPAPSSQQRVAAIGRSKVPLKPGRSLMDWIRLTKSGKDLTGLKGRLIDVTEEELAQHNKKEDCWICIRGMVYNITPYMEYHPGGEEELMKAAGRDGTDLFDQVHRWVNYESMLKECLIGRMAIKHVSISKEVTSVENKMNKHLNGSVASSKMSRTSSKESHPWYDWFQTESLVTVAVYTKMKNVCSELVIVDHLENVLRGEIIIGDYSYLLHSELSHPVQKDIEVKVSATAGKIEIKMKKKEPVSWKSLGQPMDGHNSFLKHSQRGLYYRKCRLASKTDINYNTKLFCVQLPQGCHLQVPVGHHIYLKMNISGVDIVKPYTPVASCLLPDAQYSTFCNKQCLYLMIKIYPNGSITPHLENLTVGDYISISNPQGTFSSFQIENVMDVFLVAAGTGITPMIRLLQHVLTCVSSLRKAKLIFFNKKEEDILWKEQVEELSLADKRFEAQLILSEPSVKWTGYRGQISYSLLNESILRTEEGSKILICICGPNAFVDQGISFLQDLGFSKEEVFAFRE

SEQ ID NO: 2089 - protein, 213 aa, Xenopus tropicalis
MADTSGPQSSHISSSAGEKGSGCAVQDLLYWRDVKQSGMVFGGTMVLLLSLAAFSIISVISYLVLSLLAVTISYRVYKSVLQAVQKTDEGHPFKPLLEKDIALSSDAFQKALSTSLAHVNHALKYIVRLFLVEDLVDSLKLALLMWLMTYVGAVFNGITLLILGVLLAFTAPIVYEKYKVQIDHYVSLVHSHVKSITEKIQAKLPGALKKKSE

SEQ ID NO: 2090 - protein, 33 aa, Xenopus tropicalis
LYNSTNIKVKLISPNCPTPVKLTVKWYLRSHRC

SEQ ID NO: 2091 - protein, 34 aa, Xenopus tropicalis
IKVKLISPNCPTPVKLTVKWYLRSHRCYNQFTNL

SEQ ID NO: 2092 - protein, 457 aa, Xenopus tropicalis
MSAENGSPGLPNGGVCCATDSGRCSLVGNKVTVVLGAQWGDEGKGKVVDLLAQDADIVCRCQGGNNAGHTVVVDSVEYDFHLLPSGIINQNAIAFIGNGVVIHLPGLFEEAEKNLKKGQGLVGWEKRLCISDRAHIVFDFHQAADGIQEQQRQEQAGKNLGTTKKGIGPVYSSKAARSGLRMCDLVSDFSEFSQRFKLLAKQYKSMYPSLEIDIDGELKKLQDYADRVKPMVKDGVYYLYEALHGPPKNILVEGANAALLDIDFGTYPFVTSSNCTVGGVCTGLGIPPQSVGDVYGVVKAYTTRVGIGAFPTEQNNDTGEMLQTRGHEYGVTTGRKRRCGWLDLVLLRYAHMINGFTALALAKLDILDVLSEIKVGVSYKIDGKKIPHFPANQEVLNRVEVEYETLPGWNTDTCNVRTFEELPENAKKYVRYIELELGIPIKWIGVGKSRESMIQLF

SEQ ID NO: 2093 - protein, 169 aa, Xenopus tropicalis
VLLAPESLSDDAKNLSDKTIFAKLRAPCTDKGSMFLFIDSGQQICEVKAFHEEYRSWFIGQTVQQDGRLLIATPIDPMFLVLHYLIKADKEQGKFQPVEQIVVDEEFPSCSMLLQCTPVSKSLHHVTEEKEIGSKKFYKYSKEKTLVWLKKKVELTVKVLKSSNICVGG

SEQ ID NO: 2094 - protein, 98 aa, Xenopus tropicalis
LLIATPIDPMFLVLHYLIKADKEQGKFQPVEQIVVDEEFPSCSMLLQCTPVSKSLHHVTEEKEIGSKKFYKYSKEKTLVWLKKKVELTVKVLKSSNIC

SEQ ID NO: 2095 - protein, 136 aa, Xenopus tropicalis
MAEDPGLWTLLERAPIDWKEPWLIGLAVFHILCLIVTYVSFKSYPLQICHFLLMVVLVSCAEYINEFAAMHWRSYSKQQYFDSSGMFISLAFSAPLLCNTIIIVVHWVYKTLCVMTELKTLQQKRKESREKRKKKE

SEQ ID NO: 2096 - protein, 197 aa, Xenopus tropicalis
MFDRELEAFGFEKTDDLIKIVPPDLFAELCQQSVQHLQRQRSGVDCQVIFQSFQAAGVLISEDELRKIIRWITTLFSTAAKYNVTCEELLSRLISKLPKQILQVIRHVWNEEGKRLSELEKSRDLLPSGELVDFQWKIGMAVSSDSCRSLNHPYVTIELKVADYSGQITSKVFELTIPEFQNFHKQVKEMSSVLETV

SEQ ID NO: 2097 - protein, 164 aa, Xenopus tropicalis
METVLKTLFVLLVATSLTLAKDLPQATRVLQTLSRGWGDNLEWVQTYEEGLYKAKTENKPLILINHRNDCPHSLALKKAFAEHQGIQKLAEEFVLLNVVYDPTDKNLQLDGQYVPKVVFVDPSLVVRADLPGKYSNHQYTYEPADIDLLFENMKKALILLKTEL

SEQ ID NO: 2098 - protein, 201 aa, Xenopus tropicalis
MASVDLAKVGTILVKNALSGEMVELKSLWKEKTTVLLFLRRFGCQICRWIAKDIGKLKASCDAHQIRLVGIGPEEVGLKEFLEGNFFNGELYIDESKESYKTLGFKRYSALSVIPAALGKKVRDIVTKANADGVQGNFSGDLLQSGGMLIVSKGGEKVLLHFIQDSPGDYVPLESIVQTLGITANVTESQRPQCNDEVCTR

SEQ ID NO: 2099 - protein, 147 aa, Cebus olivaceus
MVHFTAEEKVAITSLWSKMNVEEAGGEALGRLLVVYPWTQRFFDNFGNLSSPSAILGNPKVKAHGKKVLTSFGDAIKNMDNLKTTFAKLSELHCDKLHVDPENFRLLGNVMVIILATHFGKEFTPEVQAAWQKLVSAVAIALGHKYH

SEQ ID NO: 2100 - protein, 325 aa, Bos taurus
MATVKKVLPRRLVGLATLRAVSTSSVGTFPKQVKIVEVGPRDGLQNEKNIVPTPVKIKLIDMLSEAGLPVVEATSFVSPKWVPQMADHAEVLKGIQKFPGVNYPVLTPNFKGFQAAVAAGAKEVAIFGAASELFTKKNINCSIDESLQRFDEILKAARAAGISVRGYVSCVLGCPYEGKISPAKVAEVTKKLYSMGCYEISLGDTIGVGTPGAMKDMLSAVLQEVPVTALAVHCHDTYGQALANTLTALQMGVSVMDSSVAGLGGCPYAQGASGNLATEDLVYMLAGLGIHTGVNLQKLLEAGAFICQALNRRTNSKVAQATCKL

SEQ ID NO: 2101 - protein, 130 aa, Bos taurus; identical to SEQ ID NO: 1604

SEQ ID NO: 2102 - protein, 129 aa, Bos taurus; identical to SEQ ID NO: 1605

SEQ ID NO: 2103 - protein, 332 aa, Vulpes vulpes
MSTVKEKLIENLIEEDKISQRKITIVGTGAVGMACAICILLKDLADELALVDVAVDKLKGEMMDLQHGSLFFNTSKITSGKDYSVSANSKLVIVTAGARQQEGESRLALVQRNVNIMKSIIPAVVQHSPDCKMLIVSNPVDILTYVVWKLSGLPATRVFGSGCNLDSARFRYLIGEKLGVHPTSCHGWIIGEHGDSSVPLWSGVNVAGVALKTLDPKLGTDADKDQWKNIHKQVVESAYEIIKLKGYTSWAIGLSVTDLVGSVLKNLRRVHPVSTMVKGLYGIKEEIFLSIPCVLGQNGVSDIVKINLNSDEEALFKKSADTLWNVQKELVF

SEQ ID NO: 2104 - protein, 503 aa, Oryctolagus cuniculus
MVLEMLNPMHFNITTMVPAAMPAATMPILLLTCLLLLIWNYEGTSSIPGPGYCMGIGPLISYARFLWMGIGSACNYYNKMYGEFIRVWICGEETLIISKSSSMFHVMKHSHYVSRFGSKPGLQCIGMHENGIIFNNNPALWKVVRPFFMKALTGPGLVQMVAICVGSIGRHLDKLEEVTTRSGCVDVLTLMRRIMLDTSNTLFLGIPMDESAIVVKIQGYFDAWQALLLKPNIFFKISWLYKKYEKSVKDLKDAIDILVEKKRRRISTAEKLEDHMDFATNLIFAEKRGDLTRENVNQCVLEMLIAAPDTMSVSVFFMLFLIAKHPSVEEAIMEEIQTVVGERDIRIDDIQKLKVVENFIYESMRYQPVVDLVMRKALEDDVIDGYPVKKGTNIILNIGRMHRLEFFPKPNEFTLENFAKNVPYRYFQPFGFGPRGCAGKYIAMVMMKVILVTLLRRFQVKALQGRSVENIQKKNDLSLHPDETSDLLEMIFTPRNSDTCLGQ

SEQ ID NO: 2105 - protein, 111 aa, Sus scrofa
VMKHSHYTSRFGSKPGLQFIGMHEKGIIFNNNPVLWKAVRTYFMKALSGPGLVRMVTVCADSITKHLDKLEEVRNDLGYVDVLTLMRRIMLDTSNNLFLGIPLDEKAIVCK

SEQ ID NO: 2106 - protein, 56 aa, Sus scrofa
LQFIGMHEKGIIFNNNPVLWKAVRTYFMKALSGPGLVRMVTVCADSITKHLDKLEE

SEQ ID NO: 2107 - protein, 115 aa, Bos taurus
ITCAQEVEMMIKQLEAQLEQLKLTVKSKTAVPTSQVFPIFIALSNLWTSFQDETVLISILSNLTTHLEPFLGAHDLFFPEKVMQVLLDGVTVKTDVCRIKEHIEDKVNVADFKKL

SEQ ID NO: 2108 - protein, 105 aa, Bos taurus
MMIKQLEAQLEQLKLTVKSKTAVPTSQVFPIFIALSNLWTSFQDETVLISILSNLTTHLEPFLGAHDLFFPEKVMQVLLDGVTVKTDVCRIKEHIEDKVNVADFK

SEQ ID NO: 2109 - protein, 582 aa, Bos taurus
MPPTQAESVIKNIIREIGQECAAHGEIVPETLVAFMVKAVVLDPSNGFNTDRTLTKSDVQKLVKLCVNRLLDSKNPSLDTIKMQVYFDMNYTSREEFLEEHHQVIESRLSSVSREITDSRACVREELESLYRKIVSYVLLRSGLGSPTDIKIVREATAALQSVFPQTELGTFLTLSKKDKERQLKELTMIVTGIRLFNRDCGKGGEGIDDLPAILQEAIPATTQHVDSQLEVVQEQAYRYTAILEKVAKNPLMSQELQPYMLREALYNVRQCEIFLQVILPIFIALSNLWTSFQDETVLISILSNLTTHLEPFLGAHDLFFPEKVMQVLLDGVTVKTDVCRIKEHIEDKVNVADFKKLEWLFPETTANFDKLLIQYRGFCAYTFATTDGLLLPGNPSIGILKYKDKYYTFNTRDAAYSFAENPENYIDIIREKAKRNAELIQLLELHQQFESLIQYSQMKEVDKRYIKPITKCETGTQTDTHLLPPTIVRSYEWNEWELRRKAIKLANLRRKVTHSVQTDHSHMRRENCSQVYPSKDVGTQSMREGSSRVPRPQIYIAGLRGGQTKTTYGVKVNLTRAVDET

SEQ ID NO: 2110 - protein, 102 aa, Bos taurus
ELRPLDVNKVLLTITTVFTELQIQIKENLCMLASIKVNNKNHSSILEEKWMTPVSFIIALKKAGLNIFPTGHSHLYVVINYKHPSVEVKAYRQMALLSSAFA

SEQ ID NO: 2111 - protein, 93 aa, Bos taurus
LDVNKVLLTITTVFTELQIQIKENLCMLASIKVNNKNHSSILEEKWMTPVSFIIALKKAGLNIFPTGHSHLYVVINYKHPSVEVKAYRQMALL

SEQ ID NO: 2112 - protein, 363 aa, Bos taurus
MSMDVTFLGTGAAYPSPTRGASALVLRCEGECWLFDCGEGTQTQLMKSQLKAGRITKIFITHLHGDHFFGLPGLLCTISLQSGSMVTKQPIEIYGPVGLRDFIWRTMELSHTELVFPYVVHELVPTADQCPTEELQESVQVDKTDNPPKEGEGRTILLDSEENSYLLVDDEQFVVKAFRLFHRIPSFGFSVVEKKRPGKLNAQKLKDLGVPPGPAYGKLKNGISVVLENGVTISPQDVLKKPIVGRKICILGDCSGVVDDAGVKLCFEADLLIHEATLDDTQMDKAKEHGHSTPQMAATFAKLCQAKRLVLTHFSQRYKPVALAREGEADGIVELKKQAESVLDLQEVTLAEDFMVISIPIKK

SEQ ID NO: 2113 - protein, 320 aa, Bos taurus
MASPKKKLQGLVAATITPMTEHGEINFSVIGRYVDYLVEEQGVKNVFVNGTTGEGLSLSISERCQVAEEWVTKGKNKLDQIVIHVGALSLKESQELAQHAAEIGADGIAVIAPFFLKPWNKDVLINFLKEVAAAAPALPFYYYHIPALTGVKIRAEELLDGIQDKIPSFQGLKFSDTDLLDFGQCVDQNRQRQFAFLFGVDEQLLSALVMGATGAVGSTYNYLGKKTKQMLEAFERKDFSSALNHQFCIQRFINFVVKLGFGVSQTKAIMTLVSGIPMGPPRLPLQKASREFTDNAEAKLKSLDFLSCTDLKDGNMEACS

SEQ ID NO: 2114 - protein, 802 aa, Staphylococcus aureus
MANTKKTTLDITGMTCAACSNRIEKKLNKLDDVNAQVNLTTEKATVEYNPDQHDVQEFINTIQHLGYGVAVETVELDITGMTCAACSSRIEKVLNKMDGVQNATVNLTTEQAKVDYYPEETDADKLVTRIQKLGYDASIKDNNKDQTSRKAEALQHKLIKLIISAVLSLPLLMLMFVHLFNMHIPALFTNPWFQFILATPVQFIIGWQFYVGAYKNLRNGGANMDVLVAVGTSAAYFYSIYEMVRWLNGSTTQPHLYFETSAVLITLILFGKYLEARAKSQTTNALGELLSLQAKEARILKDGNEVMIPLNEVHVGDTLIVKPGEKIPVDGKIIKGMTAIDESMLTGESIPVEKNVDDTVIGSTMNKNGTITMTATKVGGDTALANIIKVVEEAQSSKAPIQRLADIISGYFVPIVVGIALLTFIVWITLVTPGTFEPALVASISVLVIACPCALGLATPTSIMVGTGRAAENGILFKGGEFVERTHQIDTIVLDKTGTITNGRPVVTDYHGDNQTLQLLATAEKDSEHPLAEAIVNYAKEKQLILTETTTFKAVPGHGIEATIDHHHILVGNRKLMADNDISLPKHISDDLTHYERDGKTAMLIAVNYSLTGIIAVADTVKDHAKDAIKQLHDMGIEVAMLTGDNKNTAQAIAKQVGIDTVIADILPEEKAAQIAKLQQQGKKVAMVGDGVNDAPALVKADIGIAIGTGTEVAIEAADITILGGDLMLIPKAIYASKATIRNIRQNLFWAFGYNIAGIPIAALGLLAPWVAGAAMALSSVSVVTNALRLKKMRLEPRRKDA

SEQ ID NO: 2115 - protein, 493 aa, Staphylococcus aureus
MDASTLFKKVKVKRVLGSLEQQIDDITTDSRTAREGSIFVASVGYTVDSHKFCQNVADQGCKLVVVNKEQSLPANVTQVVVPDTLRVASILAHTLYDYPSHQLVTFGVTGTNGKTSIATMIHLIQRKLQKNSAYLGTNGFQINETKTKGANTTPETVSLTKKIKEAVDAGAESMTLEVSSHGLVLGRLRGVEFDVAIFSNLTQDHLDFHGTMEAYGHAKSLLFSQLGEDLSKEKYVVLNNDDSFSEYLRTVTPYEVFSYGIDEEAQFMAKNIQESLQGVSFDFVTPFGTYPVKSPYVGKFNISNIMAAMIAVWSKGTSLETIIKAVENLEPVEGRLEVLDPSLPIDLIIDYAHTADGMNKLIDAVQPFVKQKLIFLVGMAGERDLTKTPEMGRVACRADYVIFTPDNPANDDPKMLTAELAKGATHQNYIEFDDRAEGIKHAIDIAEPGDTVVLASKGREPYQIMPGHIKVPHRDDLIGLEAAYKKFGGGPVD

SEQ ID NO: 2116 - protein, 228 aa, Staphylococcus aureus
MTHLLIVDDEQDIVDICQTYFEYEGYKVTTTTSGKEAISLLSNDIDIMVLDIMMPEVNGYDIVKEMKRQKLDIPFIYLTAKTQEHDTIYALTLGADDYVKKPFSPRELVLRINNLLTRMKKYHHQPVEQLSFDELTLINLSKVVTVNGHEVPMRIKEFELLWYLASRENEVISKSELLEKVWGYDYYEDANTVNVHIHRIREKLEKESFTTYTITTVWGLGYKFERSR

SEQ ID NO: 2117 - protein, 92 aa, Bos taurus
GAATSVVTWVVAVFASLPGIIFTKSQKEGSRHTCSPHFPSSQYHFWKNFQTLKIVILGLVLPLLVMIVCYSGIIKTLLRCRNEKKKHKAVRL

SEQ ID NO: 2118 - protein, 33 aa, Bos taurus
HFWKNFQTLKIVILGLVLPLLVMIVCYSGIIKT

SEQ ID NO: 2119 - protein, 89 aa, Solanum tuberosum
KGAAEVLKLNMALILLPVCRNTITWLRNKTKLGGAVPFDDNINFHKVVAGAIAVGVGIHVLAHMTCDFPRLLNASPEKYKPMEPYFGDQ

SEQ ID NO: 2120 - protein, 74 aa, Solanum tuberosum
HLFVIVYSLLIVHGIELYLTKEWYKKTTWMYLAIPIILYSGERLLRAFRSSVKDVKILKVAMYTGNVLTLQMSK

SEQ ID NO: 2121 - protein, 196 aa, Bos taurus
EFNLFPESVVFESNFVQVRKGRDWIDIYKTYNTMALGVTSSVPCLPLPNILLMASVKWHHGQNQTWNKPSTAPKIILKRILPLKFVELQVSDHLQRVLRLRTVTEKIYYLKLHPDHPKTVFHFWIRLIQILQKGLSITTKDPRILVTHCLVPKNSCSPSGDSQLVQKKPQASQPSESLMQLMAKGESEALCQIFVD

SEQ ID NO: 2122 - protein, 362 aa, Bos taurus
MAPMGIRLSPLGVAVFCLLGLGVLYHLYSGFLAGRFSLFGLGGEPGGGAAGPAGPAASADGGTVDLREMLAVSVLAAVRGGEEVRRVRESNVLHEKSKGKTREGADDKMTSGDVLSNRKMFYLLKTAFPSVQINTEEHVDASDQEVILWDRKIPEDILKEIATPQEVPAESVTVWIDPLDATQEYTEDLRKYVTTMVCVAVNGKPVLGVIHKPFSEYTAWAMVDGGSNVKARTSYNEKTPRIVVSRSHSGMVKQVALQTFGNQTTIIPAGGAGYKVLALLDVPDKSQEKADLYIHVTYIKKWDICAGNAILKALGGHMTTLSGEEISYTGSDGIEGGLLASIRMNHQALVRKLPDLEKTGHK

SEQ ID NO: 2123 - protein, 322 aa, Bos taurus
MSSKPQSIGVIGAPFSKGQPRGGVEEGPTVLRKAGLLEKLKELECDVKDYGDLSFADNLDDSPFQIVKNPRCVGKASEKLADVVAEVKKTGRISLVLGGDHSLAIGSISGHARVHPDLCVIWVDAHTDINTPLTTKTGNLHGQPVSFLLKELKEKMPEVPGFYWVAPCISAKDIVYIGLRDVDPGEHYILKTLGIKYFSMTEVDKLGIGKVMEETFSYLLGRKKRPIHLSFDVDGLDPSFTPATGTPVQGGLTYREGLYITEEIYKTGLLSGLDIMEVNPSLGKTPEEVTRTVNTTVAITMACFGVAREGNHKPIDYLSPPK

SEQ ID NO: 2124 - protein, 103 aa, Bos taurus
LCVIWVDAHTDINTPLTTKTGNLHGQPVSFLLKELKEKMPEVPGFYWVAPCISAKDIVYIGLRDVDPGEHYILKTLGIKYFSMTEVDKLGIGKVMEETFSYLL

SEQ ID NO: 2125 - protein, 183 aa, Bos taurus
AGLLEKLKELECDVKDYGDLSFADNLDDSPFQIVKNPRCVGKASEKLADVVAEVKKTGRISLVLGGDHSLAIGSISGHARVHPDLCVIWVDAHTDINTPLTTKTGNLHGQPVSFLLKELKEKMPEVPGFYWVAPCISAKDIVYIGLRDVDPGEHYILKTLGIKYFSMTEVDKLGIGKVMEETF

SEQ ID NO: 2126 - protein, 333 aa, Bos taurus
MFRAAAPGQLRRATSLLRFQSTLVIAEHANDTLAPITLNTITAAKHLGGEVSCLVAGTKCDKVAQDLCKVAGVAKVLVAQHDAYKGLLPEELTPLILATQKQFNHTHICAGASAFGKNLLPRIAAKLDVAPISDIIAIKSPDTFVRTIYAGNAICTVKCDEKVKVFSVRGTSFEAAAASGGSASSEKASSTSPVGISEWLDQKLTKSDRPELTGAKVVVSGGRGLKSGENFKLLYDLADQLHAAVGASRAAVDAGFVTNDLQVGQTGKIVAPELYIAVGISGAIQHLAGMKDSKTIVAINKDPEAPIFQVADYGIVADLFKVVPEMTELLKKK

SEQ ID NO: 2127 - protein, 339 aa, Bos taurus
MGDRSPFETDMLTLTRYVMEKGRQAKGTGELTQLLNSMLTAIKAISSAVRKAGLANLYGIAGSVNVTGDEVKKLDVLSNALVINMLQSSYSTCVLVSEENKEAIITSKEKRGKYVVCFDPLDGSSNIDCLASIGTIFAIYRKTSEDEPSEKDALQPGRNIVAAGYALYGSATLVALSTGQGVDLFMLDPALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGR

SEQ ID NO: 2128 - protein, 147 aa, Scapanus orarius
MVHLSAEEKGLVTGLWGKVNVDDVGAEALGRLLVVYPWTQRFFDSFGDLSSAGAIMGNPKVKAHGKKVANSISDGIKNLDNLKGTYAKLSELHCDKLHVDPENFRLLGNVLVCVMARTLGKEFTPHAQAAFQKMVLGVATALAHKYH

SEQ ID NO: 2129 - protein, 147 aa, Scalopus aquaticus
MVHMSAEEKGIVTSMWGKVNVDDIGAEALGRLLVVYPWTQRFFDSFGDLSSPAAIMGNPKVKAHGKKVAHSISDGIKNLDNLKGTYAKLSELHCDKLHVDPENFRLLGNVLVCVLARNLGKEFTPHARTAFQKMVLEVAAALAHKYH

SEQ ID NO: 2130 - protein, 72 aa, Oryctolagus cuniculus
IIQTLFSCKNHKKAKAIKLILLVVIVFFLFWTPYNVMIFLETLKLYGFFPNCDMKRDLRLALSVTETVAFSH

SEQ ID NO: 2131 - protein, 34 aa, Oryctolagus cuniculus
TLFSCKNHKKAKAIKLILLVVIVFFLFWTPYNVM

SEQ ID NO: 2132 - protein, 340 aa, Cavia porcellus
MDETGNPTIPPASNNTCYDSIDDFRNQVYSTLYSMISVVGFFGNGFVLYVLVKTYHEKSAFQVYMINLAVADLLCVCTLPLRVAYYVHKGIWLFGDFLCRLSTYALYVNLYCSIFFMTAMSFFRCVAIVFPVQNISLVTQKKARLVCIAIWMFVILTSSPFLMANTYKDEKNNTKCFEPPQDNQAKNYVLILHYVSLFIGFIIPFITIIVCYTMIIFTLLKSSMKKNLSSRKRAIGMIIVVTAAFLVSFMPYHIQRTIHLHFLHNKTKPCDSILRMQKSVVITLSLAASNCCFDPLLYFFSGGNFRRRLSTIRKYSLSSMTYIPKKKTSLPQKGKDICKE

SEQ ID NO: 2133 - protein, 1020 aa, Oryza sativa
MESYLEENFGGVKAKNSSEEALRRWRKLCGVVKNPKRRFRFTANLDKRGEAQAIKHANHEKLRVAVLVSKAALQFIQGLSLRSEYVVPEEVKAAGFQICADELGSIVEGHDSKKLITHGGVTGIADKLATSPADGLSTAEESIKRRQDVYGLNKFTESEVRSFWVFVWEALQDTTLIILAVCAFVSLVVGIAMEGWPKGAHDGLGIVASILLVVFVTATSDYRQSLQFKDLDKEKKKIQVQVTRNGFRQRLSIYDLLPGDVVHLAIGDQVPADGLFISGFSLLINESSLTGESEPVVVNEDNPFLLSGTKVQDGSCKMLITTVGMRTQWGKLMATLSEGGDDETPLQVKLNGVATIIGKIGLFFAVITFIVLSQGLISKKYHEGLLLSWSGDDALEMLEHFAIAVTIVVVAVPEGLPLAVTLSLAFAMKKMMNDKALVRHLAACETMGSATTICSDKTGTLTTNHMTVVKACICGNIKEVNNPKNASDLCSELPETVVKTLLESIFNNTGGEVVIDQDGKYQILGTPTETALLEFALSLGGNFKAKRDETKIVKMEPFNSTKKRMCVVLKLPGGGCRAHCKGASEIVLAACDKFMDETGAVVPLDKTTADKLNGIIESFANEALRTLCLGYREMEEGFSVEEQIPLQGYTCIGIVGIKDPVRPGVRESVATCRSAGIMVRMVTGDNINTAKAIARECGILTEDGLAIEGPEFREKSLDELLKLIPKIQVMARSSPLDKHTLVKHLRTTFNEVVAVTGDGTNDAPALHEADIGLAMGIAGTEVAKESADVIILDDNFSTIVTVAKWGRSVYVNIQKFVQFQLTVNVVALLVNFSSACFTGNAPLTAVQLLWVNMIMDTLGALALATEPPNDDLMKREPVGRTGKFITNVMWRNILGQSFYQFIVMWYLQTQGKSMFGLDGPDAEVVLNTIIFNSFVFCQVFNEISSREMEKINVLRGILKNYVFLGVLTSTVVFQFIMVQFLGEFANTIPLTRLQWIASVLLGLIGMPISAIIKLLPVGSS

SEQ ID NO: 2134 - protein, 100 aa, Oryza sativa
DDETPLQVKLNGVATIIGKIGLFFAVITFIVLSQGLISKKYHEGLLLSWSGDDALEMLEHFAIAVTIVVVAVPEGLPLAVTLSLAFAMKKMMNDKALVRH

SEQ ID NO: 2135 - protein, 109 aa, Oryza sativa
KLNGVATIIGKIGLFFAVITFIVLSQGLISKKYHEGLLLSWSGDDALEMLEHFAIAVTIVVVAVPEGLPLAVTLSLAFAMKKMMNDKALVRHLAACETMGSATTICSDK

SEQ ID NO: 2136 - protein, 439 aa, Oryza sativa
MESRGKILMERYELGRLLGKGTFGKVHYARNLESNQSVAIKMMDKQQVLKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVALVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLAWHGDE

SEQ ID NO: 2137 - protein, 303 aa, Oryza sativa
MAGMSLQHPWAFAFGLLGNIISFMTYLAPLPTFYRIYKSKSTQGFQSVPYVVALFSAMLWIYYALLKSDECLLITINSAGCVIETIYIAVYLVYAPKKAKMFTAKLLLLVNVGVFGLILLLTLLLSAGDRRIVVLGWVCVGFSVSVFVAPLSIIRLVVRTKSVEFMPFSLSFSLTISAVVWFLYGLLIKDKYVALPNVLGFSFGVIQMGLYAMYRNSTPKAVLTKEVEAATATGDDDHSAAGVKEHVVNIAKLSAAVDVVKTREVHPVDVESPPAEAPPEEDDKAAAATAAAVAGAGEKKVAA

SEQ ID NO: 2138 - protein, 434 aa, Oryza sativa
MESRGKILMERYELGRLLGKGTFGKVHYARNLESNQSVAIKMMDKQQILKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVAPVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLA

SEQ ID NO: 2139 - protein, 83 aa, Bos taurus
VNTLKKEASSYQLKLREKDNSLRIISAVIESMKYWREHVQKTVLLFEILAVLDSAVRPGPYCSKTFLMRDGKHTLPCVFYEID

SEQ ID NO: 2140 - protein, 1156 aa, Xenopus laevis
MSKREAFLQATAKDSVEDFLSFIQLHKDVSDPFDLNELLQELSRKQKEELWEKLKTLLTEALVANPVERWQNIDDDSDDDMEVESSSDVKQTMCVIHGVTIAAAASLCVIDEDVCYETLLECAAILSGIVHALPKSESHITLAIRHLCEAWWEKGLQGKEEFGKTAFLLLLAKSLEVKCVVADIGRLWHLHQTLLSFDFNSEESHNVKDLLLQCFLSINHIKKEEGRRFLSFLFSWDVNFIKMIHGTIKNQLQCLPKSLMTHIADIYFRAWKKASGDVLQTIEQSCIQDFMHHGVHLPRNSPLHPKVREVLSYFHQQKLRQGVEEMLYNLYQPIIWRGLKARNSEVRSNAALLFVEAFPIRDPNLNHEDMDNEIQKQFEELFNLLEDPQPLVRSTGVLGVCKITAKYWEMIPPAILTDLLRKILGDLAADVSSADVRCSVFKCLPILLDNKLSHPLLENMLPALKFCLHDNSEKVRVAFVDMLLKIKAVRAAKFWKICPMEQILARLEVDSRPVSRRIVNLLFNSFFPVNQQEEVWCERCVALIQMNPAAARKFYQYAYEHTAPTNIAKLMLTIRRCLNACINRTVPNEDTEDEDDDEGDGEGIVRGDSEKENKSVLENVLSTEDSASMASLLEIVVVLWRSIRKALDQNEEAKTYTISKFASVLPEYFKAFKEERCTVPLIILASFMPPAAVPTFSCSVLSKLRHLDSGADEQKYSTLIDCLCRWGQVGHVLELASEWLSESYPEKRGRKDSNRQVRIQDTMESKPALALDYIEYIMTHTMNRDCLLSLQTKKLNQLLKVLGLVKEVLFCYIKPSEAVTHNVNQDTALRAFSLYCRLSIHLQHKFSSEGRTYLSVLEDTGGWIESQVLPTLESNQDISEEPRNMCHQILKAYLTVCKDVLMVGLADSEFQAQLLQITLSVIQTEKCHNCLPMLFYVLKEITELCLAHKMSDASVECDEMLDAIQKAFHKSLETVARRLRKQREEALQLLQTIQLPLGEFVHTVQCWHTASKVLHRGTLSTLLAAVVVEISHSLRKITDLSELTPPSSISDLPPLSKCIMTIIVKSPSAVSSFLDELTECITLEEVEGILSLTAALYVAVVSSKRKQIPPAVKNTASAIYRKLKNFCEVTMDDAGSIERAVYESSMRILNEMLHPS

SEQ ID NO: 2141 - protein, 63 aa, Bos taurus
KCIVLQVLRGLQYLHRNFIIHRDLKVSNLLMTDKGCVKTADFGLARAYGIPVKPMTPKVVTLW

SEQ ID NO: 2142 - protein, 147 aa, Bos taurus
DTHTDEIVALKKVRMDKEKDGVPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGIPVKPMTPKVVTLWY

SEQ ID NO: 2143 - protein, 542 aa, Mus musculus
MYIRVSYDTKPDSLLHLMVKDWQLELPKLLISVHGGLQSFEMQPKLKQVFGKGLIKAAMTTGAWIFTGGVSTGVVSHVGDALKDHSSKSRGRLCAIGIAPWGMVENKEDLIGKDVTRVYQTMSNPLSKLSVLNNSHTHFILADNGTLGKYGAEVKLRRQLEKHISLQKINTRLGQGVPVVGLVVEGGPNVVSIVLEYLKEDPPVPVVVCDGSGRASDILSFAHKYCDEGGVINESLRDQLLVTIQKTFNYSKSQSYQLFAIIMECMKKKELVTVFRMGSEGQQDVEMAILTALLKGTNASAPDQLSLALAWNRVDIARSQIFVFGPHWPPLGSLAPPVDTKATEKEKKPPTATTKGRGKGKGKKKGKVKEEVEEETDPRKLELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKSFRTLYNNLFGPKRVELSRHTVSCASQSNMWFLDVLPQKPTCAECNSSPHLSQTDITPPLP

SEQ ID NO: 2144 - protein, 443 aa, Mus musculus
MYIRVSYDTKPDSLLHLMVKDWQLELPKLLISVHGGLQSFEMQPKLKQVFGKGLIKAAMTTGAWIFTGGVSTGVVSHVGDALKDHSSKSRGRLCAIGIAPWGMVENKEDLIGKDVTRVYQTMSNPLSKLSVLNNSHTHFILADNGTLGKYGAEVKLRRQLEKHISLQKINTRLGQGVPVVGLVVEGGPNVVSIVLEYLKEDPPVPVVVCDGSGRASDILSFAHKYCDEGGVINESLRDQLLVTIQKTFNYSKSQSYQLFAIIMECMKKKELVTVFRMGSEGQQDVEMAILTALLKGTNASAPDQLSLALAWNRVDIARSQIFVFGPHWPPLGSLAPPVDTKATEKEKKPPTATTKGRGKGKGKKKGKVKEEVEEETDPRKLELLNWVCAHVLVSLPVCLQSSGLAFPKFSGRDSLVTFASSLPGWGTDGLMSILHGNSVFTSM

SEQ ID NO: 2145 - protein, 426 aa, Mus musculus
MVKDWQLELPKLLISVHGGLQSFEMQPKLKQVFGKGLIKAAMTTGAWIFTGGVSTGVVSHVGDALKDHSSKSRGRLCAIGIAPWGMVENKEDLIGKDVTRVYQTMSNPLSKLSVLNNSHTHFILADNGTLGKYGAEVKLRRQLEKHISLQKINTRLGQGVPVVGLVVEGGPNVVSIVLEYLKEDPPVPVVVCDGSGRASDILSFAHKYCDEGGVINESLRDQLLVTIQKTFNYSKSQSYQLFAIIMECMKKKELVTVFRMGSEGQQDVEMAILTALLKGTNASAPDQLSLALAWNRVDIARSQIFVFGPHWPPLGSLAPPVDTKATEKEKKPPTATTKGRGKGKGKKKGKVKEEVEEETDPRKLELLNWVCAHVLVSLPVCLQSSGLAFPKFSGRDSLVTFASSLPGWGTDGLMSILHGNSVFTSM

SEQ ID NO: 2146 - protein, 436 aa, Arabidopsis thaliana
MKRRRKDLKQAAESEQEECQSIAQVVSLGDSDQIQPPPNKKEEEDICEYLLQNFDLDHVMEILMRFPLTSLTRFKCVSKQWSSLISSRYFCNLLYTTVTRQQPRLYMCLKDDGGHRVLLSISSPSRGNTSFVVVEQDLSIPGMGGFFLNVVRGLMCFSRRKKARIYNPSTKQLLTLPAIKSDIVAQQGQTKHHPRYYIGHDPVSDQYKLVCTVAISSLLPRLGNLKSEHWVFALEAGGSWKKVVPLENYRHHAPSTEGRSTSGSVVRYMAWPDNYNCVVVSFDIRSEQLTIIPVPREIHLDEVVPAVTMMADLIEYGGKIAIFYHTNLKDEGSADLWVLEDTGKSEWSKKTLVLQPCQRHLVEDIELIVKGTTQDGKVILAPVEMHSRFYILYYNLQSNDLRKVEIKGVPDSWFDKECYFDLNSMDKSESFIYLET

SEQ ID NO: 2147 - protein, 257 aa, Arabidopsis thaliana
MEKYEKLEKVGEGTYGKVYKAMEKTTGKLVALKKTRLEMDEEGIPPTALREISLLQMLSQSIYIVRLLCVEHVIQSKDSTVSHSPKSNLYLVFEYLDTDLKKFIDSHRKGSNPRPLEASLVQRFMFQLFKGVAHCHSHGVLHRDLKPQNLLLDKDKGILKIADLGLSRAFTVPLKAYTHEIVTLWYRAPEVLLGSTHYSTAVDIWSVGCIFAEMIRRQALFPGDSEFQQLLHIFRYLLLVFDANVYVYRNQFRTLAH

SEQ ID NO: 2148 - protein, 178 aa, Fragaria ananassa
VPLLEKVGKELVTGMIKKHGEEGGARVSCLVNNPFIPWVCDVATELGIPCATLWIQSCAVFSAYFHYNAETVKFPTEAEPELDVQLPSTPLLKHDEIPSFLHPFDPYAILGRAILGQFKKLSKSSYILMDTIQELEPEIVEEMSKVCLVKPVGPLFKIPEATNTTIRGDLIKADDCLD

SEQ ID NO: 2149 - protein, 599 aa, Bos taurus
MPEIRVTPLGAGQDVGRSCILVSIAGKNVMLDCGMHMGFSDDRRFPDFSYNTRSGRLTDFLDCVIISHFHLDHCGALPYFSEMVGYDGPIYMTQPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPSLLITESTYATTIRDSKRCRERDFLKKVHETVERGGKVLIPVFALGRAQELCILLETFWERMDLKAPIYFSTGLTEKANHYYKLFIPWTNQKIRKTFVQRNMFEFKHIKAFDRAFADSPGPMVVFATPGMLHAGQSLQIFRKWAGNEKNMVIMPGYCVQGTVGHKILSGQRKLEMEGRQVLEVKMQVEYMSFSAHADAKGIMQLVGQAEPENVLLVHGEAKKMEFLKQKIEQEFRVNCYMPANGETVTLPTSPSIPVGISLGLLKREMAQGLLPDAKKPRLLHGTLIMKDSNFRLVSSEQALKELGLAEHQLRFTCRVHLHDTRKEQEMAMRVYSHLKSVLKDHCVQHLPDGSVTVESILVQAAAHSEDPGTKVLLVSWTYQDEELGSYLTSLLKKGLPQAS

SEQ ID NO: 2150 - protein, 341 aa, Danio rerio
MAPMGIRLSPLGIAVFCLLGVGVIYHLYAGVLSSRLAFFRQKRTVDLRELLALSIDAAVQGGREVKRIREDNTLEEKSKGKTKEGASEKYTLGDLNSHRKMYYLIKNTFPNIQVNSEEHANAEGEATVWTRMIPEDILAKVSGGKEIPAEKITVWIDPLDATQEYTENLLKYVTTMVCVAVDGEPVIGVIHKPFTGYTVWGFVGEGSNVAPRDSYNTNSPKVIVSRSHAGKVKSFVQTAFGNNTEIIPAGGAGYKALALLNPTDDKQETADIYIHVTYIKKWDICAGDAILKSLGGQMTTLKGEQIDYSGLEGNKGGLLASMKVDHKALVKRLPLWEDNKQ

SEQ ID NO: 2151 - protein, 466 aa, Brucella abortus
MTASQDFVVKDISLADWGRKELDIAETEMPGLMAAREEFGKSQPLKGARISGSLHMTIQTAVLIETLKVLGAEVRWASCNIFSTQDHAAAAIAATGTPVFAVKGETLEEYWTYTDQIFQWPDGEPSNMILDDGGDATMYILIGARAEAGEDVLSNPQSEEEEVLFAQIKKRMAATPGFFTKQRAAIKGVTEETTTGVNRLYQLQKKGLLPFPAINVNDSVTKSKFDNKYGCKESLVDGIRRGTDVMMAGKVAVVCGYGDVGKGSAQSLAGAGARVKVTEVDPICALQAAMDGFEVVTLDDAASTADIVVTTTGNKDVITIDHMRKMKDMCIVGNIGHFDNEIQVAALRNLKWTNVKPQVDLIEFPDGKRLILLSEGRLLNLGNATGHPSFVMSASFTNQVLGQIELFTRTDAYKNEVYVLPKHLDEKVARLHLDKLGAKLTVLSEEQAAYIGVTPQGPFKSEHYRY

SEQ ID NO: 2152 - protein, 141 aa, Brucella abortus
KDVITIDHMRKMKDMCIVGNIGHFDNEIQVAALRNLKWTNVKPQVDLIEFPDGKRLILLSEGRLLNLGNATGHPSFVMSASFTNQVLGQIELFTRTDAYKNEVYVLPKHLDEKVARLHLDKLGAKLTVLSEEQAAYIGVTP

SEQ ID NO: 2153 - protein, 126 aa, Brucella abortus
VITIDHMRKMKDMCIVGNIGHFDNEIQVAALRNLKWTNVKPQVDLIEFPDGKRLILLSEGRLLNLGNATGHPSFVMSASFTNQVLGQIELFTRTDAYKNEVYVLPKHLDEKVARLHLDKLGAKLTV

SEQ ID NO: 2154 - protein, 96 aa, Mus musculus
MKLLQVLLVLLFVALADGAQPKRCFSNVEGYCRKKCRLVEISEMGCLHGKYCCVNELENKKHKKHSVVEETVKLQDKSKVQDYMILPTVTYYTISI

SEQ ID NO: 2155 - protein, 235 aa, Bos taurus
MKFTFCLTVLAGTFFSAHSSVQKDDPSPYLVYLKSHFNPCVGVLIKSNWVLAPAHCYLPNLKVMLGNLRIRIRDGTEQTINPIQIIRYWNHSHTAPQDDLMLIRLAKPAILNEKVQPIALATSTVKPGTICMLSGLDWSQNNNGRHPDLRQNLEAPVMSDTACQETEQGKSHRNSICVKFLKVFSRIFGELAVATVICKNKLQGIEVGHFMGGDVGIYTNVQKYVSWIESTTKDK

SEQ ID NO: 2156 - protein, 137 aa, Bos taurus
GQAIKVTHKATGKVMVMNELIRCDEETQKTFLTEVKVMRSLDHPNVLKFIGVLYKDKKLNLLTEYIEGGTLKDFLRNVDPFPWQQKVRFAKGIASGMAYLHSMCIIHRDLNSHNCLIKLDKTVVVADFGLSRLIVEE

SEQ ID NO: 2157 - protein, 125 aa, Bos taurus
TGKVMVMNELIRCDEETQKTFLTEVKVMRSLDHPNVLKFIGVLYKDKKLNLLTEYIEGGTLKDFLRNVDPFPWQQKVRFAKGIASGMAYLHSMCIIHRDLNSHNCLIKLDKTVVVADFGLSRLIV

SEQ ID NO: 2158 - protein, 335 aa, Bos taurus
MALQALQSSGVAFRKILSHFPEELSLAFAYGSGVYRQAGPSSDQKNAMLDFVFTVDDPWHSKNLKRNWNHYSFLKVLGPRIITAVQNNYGAGVYYNTLITCDGRLIKYGVISTSVLIEDLLNWNNLYIAGRLQKPVKIVAMNEDVALRSALDQNLKSAVTAAFLMLPESFSEEDLFTEIAGLSYSGDFRMVVGEDKAKVLNIVKPNMAHFRELYGSILQESPQVVYKAQQGSLEIDKSPEGQFTQLMTLPKTLQQQINHIMDPPGKNRDVEETLLQVAHDPDCGDVVRLGLAAIVRPSSMRQSTKGIFTAGLKKSVVYSSLKLHKMWKGWVRKTS

SEQ ID NO: 2159 - protein, 36 aa, Bos taurus
TRKETYVGHELLNMEAPLKLINPLKYGIVVDWDCIQ

SEQ ID NO: 2160 - protein, 138 aa, Bos taurus
VLAADKSTKRVELTPEDVKDAHWFYDTPGITKENCILSLLTEKEVNIVLPTHSIIPRTFMLKPGMVLFLGALGRIDFLKGNQSAWFTVVASNFLPVHITSLDKADTMYQKHAGHTLLKVPVGGEERMAGFPPLVAEDI

SEQ ID NO: 2161 - protein, 77 aa, Bos taurus
KEVNIVLPTHSIIPRTFMLKPGMVLFLGALGRIDFLKGNQSAWFTVVASNFLPVHITSLDKADTMYQKHAGHTLLKV

SEQ ID NO: 2162 - protein, 338 aa, Bos taurus
MLSALARPAGAALRRSFSTSAQNNAKVAVLGASGGIGQPLSLLLKNSPLVSRLTLYDIAHTPGVAADLSHIETRATVKGYLGPEQLPDCLKGCDVVVIPAGVPRKPGMTRDDLFNTNATIVATLTAACAQHCPEAMICIISNPVNSTIPITAEVFKKHGVYNPNKIFGVTTLDIVRANAFVAELKDLDPARVNVPVIGGHAGKTIIPLISQCTPKVEFPQDQLTTLTGRIQEAGTEVVKAKAGAGSATLSMAYAGARFVFSLVDAMNGKEGVVECSFVKSQETDCPYFSTPLLLGKKGIEKNLGIGKVSPFEEKMIAEAIPELKASIKKGEEFVKNMK

SEQ ID NO: 2163 - protein, 520 aa, Bos taurus
MLNVPSQSFPGPSSQQRVASGGRSKVPLKQGRSLMDWIRLTKSGKDLTGLKGRLIEVTEEELKKHNKKDDCWICIRGFVYNVSPYMEYHPGGEDELMRAAGSDGTDLFDQVHRWVNYESMLKECLVGRMAMKPALPKDYHEEKKVLNGMLPQSQVTDTLAKEGPSSPSYDWFQTDSLVTIVIYTKQKDINLDSVIVDHRDDSFRAETVIKDYSYLVHVALSHEIQEDFSVLVVENVGKIEIVLKKKENTSWKCLGHPQENHNSFIPKKDTGLFYRKCQLVSKEDVTHDTKLFCLMLPPSTHLEVPVGQHVYLRLPITGTEIVKPYTPVCDSLFSEFKEPVLPNNIYIYFLIKIYPAGFFTPELDQLQIGDYVSVSNPEGNFIISQLQELEDLFLLAAGTGFTPMVKVLNYALTNIPSLRKVKLMFFNKTEDDIIWRSQLEKLAFKDKRFEVEFVLSAPTSEWSGKQGYISPALLSEFLKRRSDTSKVLICLCGPTPFTEQGMKMLHDLNFSKDEIHSFTA

SEQ ID NO: 2164 - protein, 74 aa, Bos taurus
DIPKQLLTKNLTAFRKELVGHARKVGLVEWHPTAANILFSSGYDYKVMVWNLDSKESVIMSPVKTINCHQDVIL

SEQ ID NO: 2165 - protein, 84 aa, Bos taurus
IPKQLLTKNLTAFRKELVGHARKVGLVEWHPTAANILFSSGYDYKVMVWNLDSKESVIMSPVKTINCHQDVILSMSFNTNGSLL

SEQ ID NO: 2166 - protein, 56 aa, Xenopus laevis
LHYLSLSEKDWSRCPICYSSIIKKDLKSVVATETHLYSVGDKITMQLMRREKGVLV

SEQ ID NO: 2167 - protein, 57 aa, Xenopus laevis
LHYLSLSEKDWSRCPICYSSIIKKDLKSVVATETHLYSVGDKITMQLMRREKGVLVA

SEQ ID NO: 2168 - protein, 677 aa, Bos taurus
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHLLTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPIDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 2169 - protein, 168 aa, Bos taurus
AIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPVLEKLTQDQDVDVKYFAQEALTVLSLA

SEQ ID NO: 2170 - protein, 155 aa, Bos taurus
IIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPVLEKLTQDQDVDVKY

SEQ ID NO: 2171 - protein, 186 aa, Bos taurus
VTPYVVSLQAKDCPDMKHFLQKLVSQLMDCKVDVQSKEKESVQVIQKNVHYSMDSLSAWYMSVTQKTDPKMPRKKRTSSSQWQSPPVVLILKDMESFTTKVLQDFIIISSQHLHEFPLILIFGIATSPVVIHRLLPHAVSSLLCIELFQSLSCKEHLTTVLDKLLLTTQFPFKLSEKVLQILTNIF

SEQ ID NO: 2172 - protein, 157 aa, Bos taurus
LREIPTAALVLGVNVTDHDLTLRSLTEVLQNNVTPYVVSLQAKDCPDMKHFLQKLVSQLMDCKVDVQSKEKESVQVIQKNVHYSMDSLSAWYMSVTQKTDPKMPRKKRTSSSQWQSPPVVLILKDMESFTTKVLQDFIIISSQHLHEFPLILIFGIA

SEQ ID NO: 2173 - protein, 1020 aa, Arabidopsis thaliana [sequence omitted]

SEQ ID NO: 2174 - protein, 86 aa, Apium graveolens
DTMVADEHFILRWPKNLPLDSGAPLLCAGITTYSPLKYYGLDKPGTKIGVVGLGGLGHVAVKMAKAFGAQVTVIDISESKRKEALE

SEQ ID NO: 2175 - protein, 74 aa, Apium graveolens
MVADEHFILRWPKNLPLDSGAPLLCAGITTYSPLKYYGLDKPGTKIGVVGLGGLGHVAVKMAKAFGAQVTVIDI

SEQ ID NO: 2176 - protein, 294 aa, Antirrhinum majus
MEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 2177 - protein, 280 aa, Antirrhinum majus
AYGVVYKARDIETNEDIALKKIRLEQEDEGVPSTAIREISLLKEMHHENIVNLKDVVHREKRLYLVFEYLDLDLKKHMDSCPEFSQDLHMVKMFLCQILRGVAYCHSHRVLHRDLKPQNLLIDRGSNTIKLADFGLARAFGIPVRTFTHEVVTLWYRAPEVLLGSRHYSTPVDVWSVGCIFAEMVNQKPLFPGDSEIDELHKIFRIIGTPNEDIWPGVTSLPDFKSSFPKWPPKELATIVPNLGATGLDLLCKMLQLDPSKRITAKKALEHEYFKDIVLP

SEQ ID NO: 2178 - protein, 76 aa, Arabidopsis thaliana
GATHFINLWMFFMHSKAVAIVMTIAKVSCAVVSCATALMLVHIIPDLLSVKNRELFLKKKADELDREMGLILTQEE

SEQ ID NO: 2179 - protein, 57 aa, Arabidopsis thaliana
THFINLWMFFMHSKAVAIVMTIAKVSCAVVSCATALMLVHIIPDLLSVKNRELFLKK

SEQ ID NO: 2180 - protein, 506 aa, Arabidopsis thaliana
MTSVNVKLLYRYVLTNFFNLCLFPLTAFLAGKASRLTINDLHNFLSYLQHNLITVTLLFAFTVFGLVLYIVTRPNPVYLVDYSCYLPPPHLKVSVSKVMDIFYQIRKADTSSRNVACDDPSSLDFLRKIQERSGLGDETYSPEGLIHVPPRKTFAASREETEKVIIGALENLFENTKVNPREIGILVVNSSMFNPTPSLSAMVVNTFKLRSNIKSFNLGGMGCSAGVIAIDLAKDLLHVHKNTYALVVSTENITQGIYAGENRSMMVSNCLFRVGGAAILLSNKSGDRRRSKYKLVHTVRTHTGADDKSFRCVQQEDDESGKIGVCLSKDITNVAGTTLTKNIATLGPLILPLSEKFLFFATFVAKKLLKDKIKHYYVPDFKLAVDHFCIHAGGRAVIDELEKNLGLSPIDVEASRSTLHRFGNTSSSSIWYELAYIEAKGRMKKGNKAWQIALGSGFKCNSAVWVALRNVKASANSPWQHCIDRYPVKIDSDLSKSKTHVQNGRS

SEQ ID NO: 2181 - protein, 459 aa, Macaca fascicularis
MTILGTTFGMVFSLLQVVSGESGYAQNGDLEDAELDDYSFSCYSQLEVNGSQHSLTCAFEDPDVNTTNLEFEICGALVEVKCLSFRKLQEIYFIETKKFLLIGKSNICVKVGGKSLTCKKIDLTTIVKPEAPFDLSVIYREGANDFVVTFNTSHLQKKYVKVLMHDVAYRQEKDENKWMHVNLSSTKLTLLQRNLQPEAMYEIKVRSIPDHYFKGFWSEWSPSYYFRTPEINNSPGEMDPILLTISLLSFFSVALLVILACVLWKKRIKPIVWPSLPDHKKTLEHLCKKPRKNLNVSFNPESFLDCQIHRVDDIQARDEVEGFLQDTFPQQLEESKKQRLGGDVQSPSCPSEDVVITPESFERDSSLRCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 2182 - protein, 624 aa, Arabidopsis thaliana
MEAVIQTRGLLSLPTKPIGVRSQLQPSHGLKQRLFAAKPRNLHGLSLSFNGHKKFQTFEPTLHGISISHKERSTEFICKAEAAAAGDGAVFGEGDSAAVVASPKIFGVEVATLKKIIPLGLMFFCILFNYTILRDTKDVLVVTAKGSSAEIIPFLKTWVNLPMAIGFMLLYTKLSNVLSKKALFYTVIVPFIIYFGAFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 2183 - protein, 414 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 2184 - protein, 491 aa, Arabidopsis thaliana
MAHYINIYGKRLFDIGLYLKTSVDLILQQQHVLMSQQKFTDISLCHREAPNPKLDLPDDNRLSPLTELEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKSQPLAARNPEAQRAVQKKNLVVKQQTKPVEVIETKRNAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVNDLVYVTDNAYSSRQILVMKKAILGNLEWYLTIPTQYVFLFCFIKASISDPEVLHVQKKNLQASKTKSFSIQVLSFSSHKSIVKSDQFCKKFNLCQEVTALASEFHLGNCEAWRETVTKLKDPETKCLKVVFEYTASDACGYG

SEQ ID NO: 2185 - protein, 32 aa, Arabidopsis thaliana
TVRMMYTVGLKGIFWKVELHRGSQKLIVPILL

SEQ ID NO: 2186 - protein, 41 aa, Arabidopsis thaliana
MMYTVGLKGIFWKVELHRGSQKLIVPILLSAHLAPVFATGA

SEQ ID NO: 2187 - protein, 34 aa, Arabidopsis thaliana
KEFAWTTILLVTTIGFLVILLGVACIQQRMKHLK

SEQ ID NO: 2188 - protein, 35 aa, Arabidopsis thaliana
KEFAWTTILLVTTIGFLVILLGVACIQQRMKHLKD

SEQ ID NO: 2189 - protein, 169 aa, Cicer arietinum
KVSELAVLGSGHEALLGTYMPGQKGCFKTMAGLVHGSLSFTEITYRFTSHRRSILVLMLKLEPWRYIEKMIEMMKYSGVTVLNISHNELAVIHGKHLVGGSAKVSDEVFVEFIIPEKADLKKFLEVLSPHWNLTLYRYRNQGDLKATILMVIASFLCEIVIRKNQIDDL

SEQ ID NO: 2190 - protein, 108 aa, Cicer arietinum
KTMAGLVHGSLSFTEITYRFTSHRRSILVLMLKLEPWRYIEKMIEMMKYSGVTVLNISHNELAVIHGKHLVGGSAKVSDEVFVEFIIPEKADLKKFLEVLSPHWNLTL

SEQ ID NO: 2191 - protein, 381 aa, Coptis japonica
MCTSLSELKCPVFSTKRKLLLEFALRTSVDMAAQEGVNYLSGLGLSRLICLPMALRAAIELNVFEIISQAGPDAQLSPSDIVAKIPTKNPSAAISLDRILRMLGASSILSVSTTKSGRVYGLNEESRCLVASEDKVSVVPMLLFTSDKAVVESFYNIKDVVLEEGVIPFDRTHGMDFFQYAGKEERVNKSFNQAMGAGSTIAFDEVFKVYKGFDNLKELVDVGGGIGTSLSNIVAKHPHIRGINFELPHVIGDAPDYPGVEHVPGDMFEGVPNAQNILLKWVLHDWDDDRSIKILKNCWKALPENGTVIVIEFVLPQVLGNNAESFNALTPDLLMMALNPGGKERTTIEFDGLAKAAGFAETKFFPISQGLHVMEFHKINC

SEQ ID NO: 2192 - protein, 725 aa, Cucumis sativus
MGSNAKGRTVMEVGTDGVAIITIINPPVNSLSFDVLFSLRDSYEQALRRDDVKAIVVTGAKGKFSGGFDITAFGVLQGGKGEQPNVRNISIEMITDIFEAARKPAVAAIDGLALGGGLEVAMACHARISTPTAQLGLPELQLGIIPGFGGTQRLPRLVGLSKALEMMLTSKPIKGQEAHSLGLVDAIVPPEELINTARRWALEILERRRPWVHSLHRTDKLESLAEARKIFNLARAQAKKQYPNLKHTIACIDAVETGVVSGPRAGLWKEAEEFQGLLHSDTCKSLIHIFFAQRSTTKVPGVTDLGLVPRQIKKVAIVGGGLMGSGIATALILSNYHVVLKEVNDKFLQAGIDRVRANLQSRVKKGNMTNEKFEKSISLLKGVLNYESFKDVDMVIEAVIENVSLKQQIFSDLEKYCPPHCMLATNTSTIDLELIGERIKSRDRIIGAHFFSPAHIMPLLEIVRTKHTAAQVIVDLLDVGKNIKKTPVVVGNCTGFAVNRMFFPYSQAAILLAEHGVDPYQIDRAISKFGMPMGPFRLCDLVGFGVAAATASQFVQAFPERTYKSMLIPLMQEDKNAGESTRKGFYVYDKNRKAGPNPELKKYIEKARNSSGVSVDPKLTKLPEKDIVEMIFFPVVNEACRVLAEGIAVKAADLDIAGVMGMGFPSYRGGLMFWADSLGSNYIYSRLEEWSKQYGGFFKPCGYLAERAVQGATLSAPGGHAKPRM

SEQ ID NO: 2193 - protein, 98 aa, Bos taurus
HLQYCTQLVQQIVLSSKTPFVASNLLEKLSRQIQVMEKLSAVSDENIGNISSVIEAIPEFHKKLSLLSFWTKCCTPIGVYHSSADRVIKQLEASFART

SEQ ID NO: 2194 - protein, 78 aa, Bos taurus
YCTQLVQQIVLSSKTPFVASNLLEKLSRQIQVMEKLSAVSDENIGNISSVIEAIPEFHKKLSLLSFWTKCCTPIGVYH

SEQ ID NO: 2195 - protein, 268 aa, Danio rerio
MDGSGKGNLDQVKHVLLVLSGKGGVGKSTITTELALAFRHAGKKVGILDVDLCGPSIPRMLSVGKPEVHQCDSGWVPVYADPQQQQLALMSIAFLLEDSDEAVIWRGPKKTALIGQFVSDVAWGELDILLVDTPPGTSDEHLAVLENLRKHRVDGAVLVTTPQAVSTGDVRREITFCKKTNLKILGIVENMSGFVCPHCSECSNIFSKGGGEELAKLTGSAFLGSVPLDPLLTESLEEGRDFLQAFPESSTFTAISHIANTLLNSLNA

SEQ ID NO: 2196 - protein, 170 aa, Xenopus laevis
MAAPVMSAFGRLQGLIRTERSLLTHVQSRCIQTTSVCLKNRAARVRVGKGDKPVTYEAAHPPHYIAHRKGWLSQHTGNLDGEGGAAERTIEDVFIRRFIFGTFHGCLANEIVIKRRANLLIICAIFIRKMPTQKFYFLIGYTETLLSFLYKCPVKLEVQTVEEKVIYKYL

SEQ ID NO: 2197 - protein, 106 aa, Rattus norvegicus
ILVGTPGRIKDHLQNGKLDLTKLKHVVLDEVDQMLDMGFADQVEEILCVAYKKDSEDNPQTLLFSATCPHWVFNVAKKYMKSTYEQVDLIGKKTQKAAITVEHLAI

SEQ ID NO: 2198 - protein, 245 aa, Lynx rufus
MDDTSTLIDVKEYPDTEVQKNRVLTLEEWREKWVDGKIGFHQEQGHQLLKKHLDTFLKGENVLRVFFPLCGKAVEMKWFADRGHCVVGVEISELGIREFFTEQNLSYSEEPIMEIPGAKVFKSSSGNISLYCCNLFDLPRVNIGKFDRIWDRGALVAVNPGDRKCYTDIMLSLTRKGFRYLLAVLSYDPTKHPGPPFYVPDAEIKNLFGSTCNIHCLEKVDVFEERHKSWGIDYIVEKLYLLTEK

SEQ ID NO: 2199 - protein, 123 aa, Arabidopsis thaliana
PDDGGYHVLLANIYRAASMWEKVGQVRVSMLRQGLRKTPGCSMVEIKNEVHSFFSGSTAHPDSKKIYAFLEKLICHIKEAGYVPDTNLVLGVENDVKEQLLSTHSEKLAISFGLLNTTAGTTI

SEQ ID NO: 2200 - protein, 122 aa, Arabidopsis thaliana
VLLANIYRAASMWEKVGQVRVSMLRQGLRKTPGCSMVEIKNEVHSFFSGSTAHPDSKKIYAFLEKLICHIKEAGYVPDTNLVLGVENDVKEQLLSTHSEKLAISFGLLNTTAGTTIHVRKNL

SEQ ID NO: 2201 - protein, 403 aa, Arabidopsis thaliana
MQRERSMKRKRRRRGIKDMCNRHDCEIPPDLMIEILIRLPTKSFMRFKCVSKQWSPLISGRYFCNRLFTCVTRQQQQQPRLYMCLVAKDKQCVLLSSTSPDNTCFVLVDQDLSIPGYFFASVPGLLCFQFGTKACIYNPSTKQLLTLPSVKSDITAQQGQLKTTQYYIGRDPVNDQYKLVCTILIYSKLFANMSSEHWVFTLELGGSWKKVVPLGNYHPHAPATAGRSIDGVVHYLAWVDLYKCAVVSFNIRSEEVTTFLLPRKIWDVPVPALMMKADLIEYDGKLAIFSHSYLKDEGLVELWVLKDAAGKKKWSNMILVLQPCQRHLVHGIDLIVKGTTQDGKVILSPLEMRSQFYILCYDVQNNDLRKVEITGVPRLWLHKECNFDLKFMDESESFIYLEI

SEQ ID NO: 2202 - protein, 199 aa, Arabidopsis thaliana
ITAQQGQLKTTQYYIGRDPVNDQYKLVCTILIYSKLFANMSSEHWVFTLELGGSWKKVVPLGNYHPHAPATAGRSIDGVVHYLAWVDLYKCAVVSFNIRSEEVTTFLLPRKIWDVPVPALMMKADLIEYDGKLAIFSHSYLKDEGLVELWVLKDAAGKKKWSNMILVLQPCQRHLVHGIDLIVKGTTQDGKVILSPLEM

SEQ ID NO: 2203 - protein, 32 aa, Arabidopsis thaliana
VCTILIYSKLFANMSSEHWVFTLELGGSWKKV

SEQ ID NO: 2204 - protein, 667 aa, Saccharomyces cerevisiae
MKVSDRRKFEKANFDEFESALNNKNDLVHCPSITLFESIPTEVRSFYEDEKSGLIKVVKFRTGAMDRKRSFEKIVVSVMVGKNVQKFLTFVEDEPDFQGGPIPSKYLIPKKINLMVYTLFQVHTLKFNRKDYDTLSLFYLNRGYYNELSFRVLERCYEIASARPNDSSTMRTFTDFVSGTPIVRSLQKSTIRKYGYNLAPYMFLLLHVDELSIFSAYQASLPGEKKVDTERLKRDLCPRKPTEIKYFSQICNDMMNKKDRLGDVLATAQRIRRRYNKNGSSEPRLKTLDGLTSERWIQWLGLESDYHCSFSSTRNAEDVVAGEAASSDHDQKISRVTRKRPREPKSTNDILVAGRKLFGSSFEFRDLHQLRLCHEIYMADTPSVAVQAPPGYGKTELFHLPLIALASKGDVKYVSFLFVPYTVLLANCMIRLGRRGCLNVAPVRNFIEEGCDGVTDLYVGIYDDLASTNFTDRIAAWENIVECTFRTNNVKLGYLIVDEFHNFETEVYRQSQFGGITNLDFDAFEKAIFLSGTAPEAVADAALQRIGLTGLAKKSMDINELKRSEDLSRGLSSYPTRMFNLIKEKSEVPLGHVHKIWKKVESQPEEALKLLLALFEIEPESKAIVVASTTNEVEELACSWRKYFRVVWIHGKLGCCRKGVSHKGVCH

SEQ ID NO: 2205 - protein, 359 aa, Arabidopsis thaliana
MMACCLRNKRRMKGKLSWKSKKRDLSHSGNWAPEDDNDEGKIVFFGGSNYTFDLDDLLAASAEILGKGAHVTTYKVAVEDTATVVVKRLEEVVVGRREFEQQMEIVGRIRHDNVAELKAYYYSKIDKLAVYSYYSQGNLFEMLHGKLSFCIPLSMLLWYAVSKTNNSTFAGESQVPLDWESRLRIAIGAARGLAIIHEADDGKFVHGNIKSSNIFTNSKCYGCICDLGLTHITKSLPQTTLRSSGYHAPEITDTRKSTQFSDVYSFGVVLLELLTGKSPASPLSLDENMDLASWIRSVVSKEWTGEVFDNELMMQMGIEEELVEMLQIGLACVALKPQDRPHITHIVKLIQDIPTNFNL

SEQ ID NO: 2206 - protein, 333 aa, Arabidopsis thaliana
MMACCLRNKRRMKGKLSWKSKKRDLSHSGNWAPEDDNDEGKIVFFGGSNYTFDLDDLLAASAEILGKGAHVTTYKVAVEDTATVVVKRLEEVVVGRREFEQQMEIVGRIRHDNVAELKAYYYSKIDKLAVYSYYSQGNLFEMLHGESQVPLDWESRLRIAIGAARGLAIIHEADDGKFVHGNIKSSNIFTNSKCYGCICDLGLTHITKSLPQTTLRSSGYHAPEITDTRKSTQFSDVYSFGVVLLELLTGKSPASPLSLDENMDLASWIRSVVSKEWTGEVFDNELMMQMGIEEELVEMLQIGLACVALKPQDRPHITHIVKLIQDIPTNFNL

SEQ ID NO: 2207 - protein, 349 aa, Arabidopsis thaliana
MDIFNGLPDDVLVKILSFVPTKVAVSTSILSKRWEFLWMWLPRLDFGSPKTDLLAFLNTCQYDKEEEVGLVDFIDKKLPLHRAPFLAMYVCWKFLMNVGMKTYFHVRHLETRQREGKSLQDILSICPVLDDLSVICSVHQDVKEFTIIVPSLQSLTLFIENCEVFDGYVIDTPLKYLKLEDVHEEEHYCLLKKMPKLREAYVDVQLDDLKSLIGSITSVKRLNHMFREKSKILGQLLKDSPNLRVLNIFKVQGHVTLSTGVDCWNQPISVPECLLESLQIFNLSHYFGKQQDLDFVVYILKNACHLKTATILADEPEHLVPNLKELTLSPRASSTCQLSIRCGLGSERS

SEQ ID NO: 2208 - protein, 315 aa, Arabidopsis thaliana
MQVTKVARMLAAKSEIDVKGCTVMALLDGGTLRRHKSWLKAEPPAILVATVASLCHMLEKHIFRIDSVRVLVVDEVDFLFYSSKQVGSVRKLLTSFSSCDKRQTVFASASIPQHKHFVHDCIQQKWTKRDVVHVHVSAIMPMPLCLLHRFVMCEKTNKHQVLLALLESDAPESAIIFVGEQSEKSKKAGNDPSTTLLMEFLKTSYKGSLEILLLEGDMNFNSRAASLTEIRQGGGFLLVSTDIAARGIDLPETTHIFNFDLPQTVTDYLHRAGRAGRKPFSDRKCIVANLITSEERFVLQRYENELMFSCEEMML

SEQ ID NO: 2209 - protein, 163 aa, Arabidopsis thaliana
KFELLSVAEKLFCRISEEGNKEAWNTMLKGYGKMKCHVKCIELFRKIQNLGIEIDSASATSVISSCSHIGAVLLGKSLHCYVVKTSLDLTISVVNSLIDLYGKMGDLTVAWRMFCEADTNVITWNAMIASYVHCEQSEKAIALFDRMVSENFKPSSITLVTLL

SEQ ID NO: 2210 - protein, 89 aa, Arabidopsis thaliana
TMLKGYGKMKCHVKCIELFRKIQNLGIEIDSASATSVISSCSHIGAVLLGKSLHCYVVKTSLDLTISVVNSLIDLYGKMGDLTVAWRMF

SEQ ID NO: 2211 - protein, 397 aa, Arabidopsis thaliana
MAVQWLLVCHGMMTLTVVISFLCGQWPIFKGTPFQWIHYFLTFGAYDYFLRFVGFVFGSKGTDVILSVEYFCCDRPNPILQVIYIAIMGSTYFLTAKSSFIYIPGYYLGDVHKYTSFLAVIVGVILFLLTCFSDPGTVNAENVSRYISAYPYDDIIYSKKECSTCKIPKPARSKHCSICNRCVARFDHHCGWMNNCIGERNTKYFMAFLLWHFLLCLYGTVAIGFILAGRVKELRVVHILTVYYGVDKSFRSLAPRVIQWLVGTYNTQILLMVFLAIVSLLLAGFFAYHANLCLTNTTTNETFKWREYISLNKKLSEAKASAAALKAGMSCELKKPSAESKCFGLCGRSSAREEEVKADAIAKRNLYDRGSFQNVSEIVFPLSSRPSSSNKSKRKSE

SEQ ID NO: 2212 - protein, 1388 aa, Arabidopsis thaliana
MTMDADAMETETTDQVSASPLHFARSYQVEALEKAIKQNTIVFLETGSGKTLIAIMLLRSYAYLFRKPSPCFCVFLVPQVVLVTQQAEALKMHTDLKVGMYWGDMGVDFWDSSTWKQEVDKYEVLVMTPAILLDALRHSFLSLSMIKVLIVDECHHAGGKHPYACIMREFYHKELNSGTSNVPRIFGMTASLVKTKGENLDSYWKKIHELETLMNSKVYTCENESVLAGFVPFSTPSFKYYQHIKIPSPKRASLVEKLERLTIKHRLSLGTLDLNSSTVDSVEKRLLRISSTLTYCLDDLGILLAQKAAQSLSASQNDSFLWGELNMFSVALVKKFCSDASQEFLAEIPQGLNWSVANINGNAEAGLLTLKTVCLIETLLGYSSLENIRCIIFVDRVITAIVLESLLAEILPNCNNWKTKYVAGNNSGLQNQTRKKQNEIVEDFRRGLVNIIVATSILEEGLDVQSCNLVIRFDPASNICSFIQSRGRARMQNSDYLMMVESGDLLTQSRLMKYLSGGKRMREESLDHSLVPCPPLPDDSDEPLFRVESTGATVTLSSSVSLIYHYCSRLPSDEYFKPAPRFDVNKDQGSCTLYLPKSCPVKEVKAEANNKVLKQAVCLKACIQLHKVGALSDHLVPDMVVAETVSQKLEKIQYNTEQPCYFPPELVSQFSAQPETTYHFYLIRMKPNSPRNFHLNDVLLGTRVVLEDDIGNTSFRLEDHRGTIAVTLSYVGAFHLTQEEVLFCRRFQITLFRVLLDHSVENLMEALNGLHLRDGVALDYLLVPSTHSHETSLIDWEVIRSVNLTSHEVLEKHENCSTNGASRILHTKDGLFCTCVVQNALVYTPHNGYVYCTKGVLNNLNGNSLLTKRNSGDQTYIEYYEERHGIQLNFVDEPLLNGRHIFTLHSYLHMAKKKKEKEHDREFVELPPELCHVILSPISVDMIYSYTFIPSVMQRIESLLIAYNLKKSIPKVNIPTIKVLEAITTKKCEDQFHLESLETLGDSFLKYAVCQQLFQHCHTHHEGLLSTKKDGMISNVMLCQFGCQQKLQGFIRDECFEPKGWMVPGQSSAAYSLVNDTLPESRNIYVASRRNLKRKSVADVVESLIGAYLSEGGELAALMFMNWVGIKVDFTTTKIQRDSPIQAEKLVNVGYMESLLNYSFEDKSLLVEALTHGSYMMPEIPRCYQRLEFLGDSVLDYLITKHLYDKYPCLSPGLLTDMRSASVNNECYALVAVKANLHKHILYASHHLHKHISRTVSEFEQSSLQSTFGWESDISFPKVLGDVIESLAGAIFVDSGYNKEVVFASIKPLLGCMITPETVKLHPVRELTELCQKWQFELSKAKDFDSFTVEVKAKEMSFAHTAKASDKKMAKKLAYKEVLNLLKNSLDY

SEQ ID NO: 2213 - protein, 1374 aa, Arabidopsis thaliana
MLLCLLGSSSGSCHSGIGVRIGVVDKGIHQYTDLSFVLQFLHYYTCSFSKFRNFSVTFSIISAFFLVCFTQQAEALKMHTDLKVGMYWGDMGVDFWDSSTWKQEVDKYEVLVMTPAILLDALRHSFLSLSMIKVLIVDECHHAGGKHPYACIMREFYHKELNSGTSNVPRIFGMTASLVKTKGENLDSYWKKIHELETLMNSKVYTCENESVLAGFVPFSTPSFKYYQHIKIPSPKRASLVEKLERLTIKHRLSLGTLDLNSSTVDSVEKRLLRISSTLTYCLDDLGILLAQKAAQSLSASQNDSFLWGELNMFSVALVKKFCSDASQEFLAEIPQGLNWSVANINGNAEAGLLTLKTVCLIETLLGYSSLENIRCIIFVDRVITAIVLESLLAEILPNCNNWKTKYVAGNNSGLQNQTRKKQNEIVEDFRRGLVNIIVATSILEEGLDVQSCNLVIRFDPASNICSFIQSRGRARMQNSDYLMMVESGDLLTQSRLMKYLSGGKRMREESLDHSLVPCPPLPDDSDEPLFRVESTGATVTLSSSVSLIYHYCSRLPSDEYFKPAPRFDVNKDQGSCTLYLPKSCPVKEVKAEANNKVLKQAVCLKACIQLHKVGALSDHLVPDMVVAETVSQKLEKIQYNTEQPCYFPPELVSQFSAQPETTYHFYLIRMKPNSPRNFHLNDVLLGTRVVLEDDIGNTSFRLEDHRGTIAVTLSYVGAFHLTQEEVLFCRRFQITLFRVLLDHSVENLMEALNGLHLRDGVALDYLLVPSTHSHETSLIDWEVIRSVNLTSHEVLEKHENCSTNGASRILHTKDGLFCTCVVQNALVYTPHNGYVYCTKGVLNNLNGNSLLTKRNSGDQTYIEYYEERHGIQLNFVDEPLLNGRHIFTLHSYLHMAKKKKEKEHDREFVELPPELCHVILSPISVDMIYSYTFIPSVMQRIESLLIAYNLKKSIPKVNIPTIKVLEAITTKKCEDQFHLESLETLGDSFLKYAVCQQLFQHCHTHHEGLLSTKKDGMISNVMLCQFGCQQKLQGFIRDECFEPKGWMVPGQSSAAYSLVNDTLPESRNIYVASRRNLKRKSVADVVESLIGAYLSEGGELAALMFMNWVGIKVDFTTTKIQRDSPIQAEKLVNVGYMESLLNYSFEDKSLLVEALTHGSYMMPEIPRCYQRLEFLGDSVLDYLITKHLYDKYPCLSPGLLTDMRSASVNNECYALVAVKANLHKHILYASHHLHKHISRTVSEFEQSSLQSTFGWESDISFPKVLGDVIESLAGAIFVDSGYNKEVVFASIKPLLGCMITPETVKLHPVRELTELCQKWQFELSKAKDFDSFTVEVKAKEMSFAHTAKASDKKMAKKLAYKEVLNLLKNSLDY

SEQ ID NO: 2214 - protein, 148 aa, Arabidopsis thaliana
VLDYLITKHLYDKYPCLSPGLLTDMRSASVNNECYALVAVKANLHKHILYASHHLHKHISRTVSEFEQSSLQSTFGWESDISFPKVLGDVIESLAGAIFVDSGYNKEVVFASIKPLLGCMITPETVKLHPVRELTELCQKWQFELSKA

SEQ ID NO: 2215 - protein, 449 aa, Arabidopsis thaliana
MKRRRRDLKQAAESEQEECQSVPQVVSLRDSDQLQIMDEKGDNSLALLPAKLPMRMCSTRERRKYTCEIPPDLLMEIVMRLPAKSMVRFKCISKQWSSLISCRYFCNSLFTSVTRKKQPHIHMCLVDHGGQRVLLSLSSTSPDNTCYVVDQDLSLTGMGGFFLNLVRGLLCFSVREKACIYNPTTRQRLTLPAIKSDIIALKDERKDIRYYIGHDPVNDQYKLVCTIGISSAFFTNLKSEHWVFVLEAGGSWRKVRTLESYHPHAPSTVGQFINGSVVYYMAWLDMDTCAVVSFDITSEELTTIIVTLEAGDVALPAGRMKAGLIQYHGEIAVFDHTHLKEKFLVDLWVLKDAGMKKWSKKRLVLQPCQKHLVHDDIELVVKGTTQDGKVILAPVNMCSQLYILCYDMGSNDLRKVEIKGVPDIWFDKECYFDLKYSLDESEDVIYLET

SEQ ID NO: 2216 - protein, 128 aa, Arabidopsis thaliana
YYMAWLDMDTCAVVSFDITSEELTTIIVTLEAGDVALPAGRMKAGLIQYHGEIAVFDHTHLKEKFLVDLWVLKDAGMKKWSKKRLVLQPCQKHLVHDDIELVVKGTTQDGKVILAPVNMCSQLYILCY

SEQ ID NO: 2217 - protein, 122 aa, Arabidopsis thaliana
AVVSFDITSEELTTIIVTLEAGDVALPAGRMKAGLIQYHGEIAVFDHTHLKEKFLVDLWVLKDAGMKKWSKKRLVLQPCQKHLVHDDIELVVKGTTQDGKVILAPVNMCSQLYILCYDMGSN

SEQ ID NO: 2218 - protein, 442 aa, Arabidopsis thaliana
MSERSPGRLSQRFRSTSVSNCCFVVSLKIMDEKGDNSLALLPAKLPMRMCSTRERRKYTCEIPPDLLMEIVMRLPAKSMVRFKCISKQWSSLISCRYFCNSLFTSVTRKKQPHIHMCLVDHGGQRVLLSLSSTSPDNTCYVVDQDLSLTGMGGFFLNLVRGLLCFSVREKACIYNPTTRQRLTLPAIKSDIIALKDERKDIRYYIGHDPVNDQYKLVCTIGISSAFFTNLKSEHWVFVLEAGGSWRKVRTLESYHPHAPSTVGQFINGSVVYYMAWLDMDTCAVVSFDITSEELTTIIVTLEAGDVALPAGRMKAGLIQYHGEIAVFDHTHLKEKFLVDLWVLKDAGMKKWSKKRLVLQPCQKHLVHDDIELVVKGTTQDGKVILAPVNMCSQLYILCYDMGSNDLRKVEIKGVPDIWFDKECYFDLKYSLDESEDVIYLET

SEQ ID NO: 2219 - protein, 128 aa, Arabidopsis thaliana; identical to SEQ ID NO: 2216

SEQ ID NO: 2220 - protein, 122 aa, Arabidopsis thaliana; identical to SEQ ID NO: 2217

SEQ ID NO: 2221 - protein, 454 aa, Arabidopsis thaliana
MNRGETLDSIPTDLILDILSRLPTKSIARFHCVSKLWSSMLASQDFTRLFVNRSSSNPRLLLGIVRGGEWSFYSSPQPKNPYEKSSLEVAADFHMKLSEIKQHQHHGTSYAFGLIYLRTVWMSKEGNYEVCVICKPSTGQYYAILPPQPSGIFGDLGFDPIGKQFKVLVLNILDNHYILTLGTENDKWRSIQSSLRYRPCGQSPICINGVLYYIAYDTQDSSNDVIGCFDVRFEKFKFFHVNHDMVKCFFELINYKDKLGGFPLELSMWVLEDLEKEEWSKYAYTLKPDNNVVKVNYNLSFVGVTTRGEIVLAKMYACKPFYVFYYNPENNTLLSVEIQGVGEDSEWFSNYQRVYVFVEHVKDLHQFDNTKTSINLPEQKRKPTSISISSKYDDHVRTTLISSRKNQQVTTVSRPQQDRRTTNKFSALCLLVMKNSQVSKPDCFSWSSATMLYL

SEQ ID NO: 2222 - protein, 224 aa, Pseudomonas fluorescens
MTQDQLKQAVAQAAVDFILPKLDDKSIVGVGTGSTANCFIDALAQHKGAFDGAVASSEATAARLKGHGIPVYELNTVSNLEFYVDGADESDEHLNLIKGGGAALTREKIVAAVAQTFICIADASKLVPVLGAFPLPVEVIPMARSHVARQLVKLGGDPVYREGVLTDNGNIILDVHNLQITNPVELEAQINAIVGVVTNGLFAARPADLLLLGTSEGVKTLKAE

SEQ ID NO: 2223 - protein, 387 aa, Pseudomonas fluorescens
MTVLKMSDLDLQGKRVLIREDLNVPVKDGVVTSDARILASLPTIKLALEKGAAVMVCSHLGRPTEGEFSAENSLKPVADYLSKALGREVPLVADYLGGVDVKAGDIVLFENVRFNKGEKKNADELAQQYAALCDVFVMDAFGTAHRAEGSTHGVAKFAKVAAAGPLLAAELDALGKALGAPAKPMAAIVAGSKVSTKLDVLNSLSQICDQLIVGGGIANTFLAAAGHPVGKSLYEPDLLDTARAIAAKVSVPLPVDVVVAKEFAESAEATVKLIADVAADDMILDIGPQTAANFAELLKSSKTILWNGPVGVFEFDQFGNGTKVLAEAIAESAAFSIAGGGDTLAAIDKYGVAEKISYISTGGGAFLEFVEGKVLPAVEVLESRAKA

SEQ ID NO: 2224 - protein, 115 aa, Xenopus laevis
ISRWVWKVYDTLFCQKSHNISLPSWATADVVKTLKEISAFDVKTHVEMHKTNEKARLTGGILVDALLRNFSDVVNKSLPLKMLMYSAHDSTLIALQGALKVYNGLHPPYSSCHII

SEQ ID NO: 2225 - protein, 93 aa, Xenopus laevis
WATADVVKTLKEISAFDVKTHVEMHKTNEKARLTGGILVDALLRNFSDVVNKSLPLKMLMYSAHDSTLIALQGALKVYNGLHPPYSSCHIIEF

SEQ ID NO: 2226 - protein, 65 aa, Rattus norvegicus
VSEDPVAIKIAELLETVTLVHKPVSLQPRGLINKGNWCYINATLQALVACPPMYHLMKFIPLYSK

SEQ ID NO: 2227 - protein, 51 aa, Rattus norvegicus
TVTLVHKPVSLQPRGLINKGNWCYINATLQALVACPPMYHLMKFIPLYSKV

SEQ ID NO: 2228 - protein, 370 aa, Rattus norvegicus
MVGKLKQNLLLACLVISSVTVFYLGQHAMECHHRIEERSQPARLENPKATVRTGLDIKANKTFTYHKNMPLIFIGGVPRSGTTLMRAMLDAHPDIRCGEETRVIPRILALKQMWSRSSKEKIRLDEAGVTDEVLDSAMQAFLLEVIVKHGEPAPYLCNKDPFALKSLTYLARLFPNAKFLLMVRDGRASVHSMISRKVTIAGFDLNSYRDCLTKWNRAIETMYNQCMEVGYKKCMLVHYEQLVLHPERWMRTLLKFLHIPWNHSVLHHEEMIGKAGGVSLSKVERSTDQVIKPVNVGALSKWVGKIPPDVLQDMAVIAPMLAKLGYDPYANPPNYGKPDPKILENTRRVHKGEFQLPDFLKEKPQTEQVE

SEQ ID NO: 2229 - protein, 71 aa, Balaenoptera acutorostrata
LTADGTINKALSEKVILFGLGKRKCIGETIARWEVFLFLAILLQQVEFRVTPGVKVDMTPVYGLTMKHAHC

SEQ ID NO: 2230 - protein, 76 aa, Balaenoptera acutorostrata
LTADGTINKALSEKVILFGLGKRKCIGETIARWEVFLFLAILLQQVEFRVTPGVKVDMTPVYGLTMKHAHCEHFQA

SEQ ID NO: 2231 - protein, 600 aa, Rattus norvegicus
MPEIRVTPLGAGQDVGRSCILVSISGKNVMLDCGMHMGYNDDRRFPDFSYITQSGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFITWTNQKIRKTFVQRNMFEFKHIKAFDRTFADNPGPMVVFATPGMLHAGQSLQIFRKWAGNEKNMVIMPGYCVQGTVGHKILSGQRKLEMEGRQMLEVKMQVEYMSFSAHADAKGIMQLVGQAEPESVLLVHGEAKKMEFLRQKIEQEFRVSCYMPANGETVTLPTSPSIPVGISLGLLKREMVQGLLPEAKKPRLLHGTLIMKDNNFRLVSSEQALKELGLAEHQLRFTCRVHLQDTRKEQETALRVYSHLKSTLKDHCVQHLPDGSVTVESILIQAAAHSEDPGTKVLLVSWTYQDEELGSFLTALLKNGLPQAPS

SEQ ID NO: 2232 - protein, 387 aa, Bos taurus
MVRCSCVLFRKYGNFIDNLRLFTKGGSGGMGYPRLGGEGGKGGDVWVVAHNRMTLKQLKDKYPQKRFVAGEGANSRVSALKGSKGKDCEIPVPVGVSVTDENGKIIGELNKEKDRLLVAEGGLGGKLLTNFLPLKGQKRVIHLDLKLIADIGLVGFPNAGKSSLLSKISHAKPAIADYAFTTIKPELGKIMYSDFKQISVADLPGLIEGAHMNKGMGHKFLKHIERTKQLLFVVDISGFQLSSQTHYRTAFETIILLSKELELYKEELHTKPALLAVNKMDLPDAQGKFHVLMNQLQNPKEFFHLFEKNMIPERTVEFQHIIPISAITGEGIDELKNCIRKSLDEHTNQENDAYHKKQLLNLHISNTVSYSEPPSKTAVSSPRMDIT

SEQ ID NO: 2233 - protein, 718 aa, Bos taurus
MADLEEGFALTAVPLGSGPDGPLGVEQSGKTDQFLVTDSGRTVILYKVSDQKPLGSWSVKQGQIITCPAVCNFQTGEYIVVHDNKVLRIWNNEDVNLDKVFKATLSAEVYRIHSIQGTEPLVLFKEGAVRGLEALLAEPQQKIETVISDEEVIKWTKFFMVFRHPVLIFITEKHGNYFVYVQKFNSRILSKYTLLLGQEEKCVIQSFSTSVGRKFISLMSLSSDGCVYETLIPIHPSEPEKNQRLVQSQLLKSVVSGSARNGVALAILDQDHIAVLGAPLPASKECLSVWNTKFQTLQTSKELPQGTSGQLWYYGENLFMLHGKFLTVVPFKCEVSSLAGALGKLKHSQDPGIHATPHFVNWETSQGCGLGSQNSEQSKRILRRRKVEVSVQPEVPASTQLLATIQKDSEKHIEVELRKFLATKRTPDFHTIIGDVIIGLLGRCKAEPSFYPCNCLMQLVQTHVLSYSLCPGLMEFALEKTDVQILQLCLQQFPDIPESVTCACLKVFLSIGDDTLQDTDINMESVSDYMDPVQDGEMEEQTAFLQNGFSPEEDNCDSCAQKLKEKPQAAADESTSCPVTPKRAALLNAVLHSAYSETFLLPHLKDIPAQHSTLFLQYLYFLYLKCSENATMTLPGTHPPTLSQIMDWICLLLDANFTVVVMIPEAKRLLLSLYKFVKSQISICSELNKIEVSFRELQKLNQEKNNRELYSIEVLELF

SEQ ID NO: 2234 - protein, 432 aa, Bos taurus
MSDKLPYKVADISLAAWGRKALDLAENEMPGLMHMREMYSASKPLKGARIAGCLHMTVETAVLIETLVALGAEVRWSSCNIFSTQDHAAAAIAKAGIPVYAWKGETDEEYLWCIEQTLYFKDGPLNMILDDGGDLTNLIHTKYPQLLSGIRGISEETTTGVHNLYKMMAKGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCTDIILGQHFEQMKDDAIVCNIGHFDVEIDVKWLNENAVEKVNIKPQVDRYLLKNGRRIILLAEGRLVNLGCAMGHPSFVMSNSFTNQVLAQIELWTHPDKYPVGVHFLPKKLDEAVAEAHLGKLNVKLTKLTEKQAQYLGVSREGPFKPDHYRY

SEQ ID NO: 2235 - protein, 150 aa, Bos taurus
IFVTTTGCTDIILGQHFEQMKDDAIVCNIGHFDVEIDVKWLNENAVEKVNIKPQVDRYLLKNGRRIILLAEGRLVNLGCAMGHPSFVMSNSFTNQVLAQIELWTHPDKYPVGVHFLPKKLDEAVAEAHLGKLNVKLTKLTEKQAQYLGVS

SEQ ID NO: 2236 - protein, 138 aa, Bos taurus
FVTTTGCTDIILGQHFEQMKDDAIVCNIGHFDVEIDVKWLNENAVEKVNIKPQVDRYLLKNGRRIILLAEGRLVNLGCAMGHPSFVMSNSFTNQVLAQIELWTHPDKYPVGVHFLPKKLDEAVAEAHLGKLNVKLTKL

SEQ ID NO: 2237 - protein, 531 aa, Bos taurus
MAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQFLEQVKVSKEMDRETLIDVARTSLRTKVHAELADVLTEAVVDSILAIKKQDEPIDLFMVEIMEMKHKSETDTSLIRGLVLDHGARHPDMKKRVEDAYILTCNVSLEYEKTEVNSGFFYKSAEEREKLVKAERKFIEDRVKKIIELKKKVCGDSDKGFVVINQKGIDPFSLDALAKEGIIALRRAKRRNMERLTLACGGIALNSLDDLNPDCLGHAGLVYEYTLGEEKFTFIEKCNNPRSVTLLIKGPNKHTLTQIKDAIRDGLRAVKNAIDDGCVVPGAGAVEVAMAEALVKYKPSVKGRAQLGVQAFADALLIIPKVLAQNSGFDLQETLVKVQAEHSESGQLVGVDLNTGEPMVAAEAGIWDNYCVKKQLLHSCTVIATNILLVDEIMRAGMSSLKG

SEQ ID NO: 2238 - protein, 497 aa, Bos taurus
MRSLLKQFAFSRRLLKVESCRITESASLILLPWASLIQKLNRVPVIFLLDQRKRFSTMPEIETNHRDSELFSPPSEVRGMTELDRTAFKKTVTIPVLKVRKEVVNKLMRSLKRAALQRPGIKRVIEDPEDGEGRLIMLDPYKMFTVDSFEKEELSILKQLNVNPQISKYNLDLTYENFKSEEILRAVLPEGQDVTSGFSRVGHIAHLNLRDHQLPYKHLIGQVMIDKNPGITSAVNKINNIDNTYRNFEMEVLSGEENMMTKVRENNYTYEFDFSKVYWNPRLSTEHSRITELLKPGDVLFDVFAGVGPFAIPAAKKKCTVFANDLNPESHKWLLHNCKLNKVDQKVKVFNLDGRDFLQGPVREELMQQLGPLSKERKHSVHIVMNLPAKAIEFLSAFKALLEGQPCGSELLPIVHCYSFSKDANPAKDVQQRAATVLGISLEAYSSVHLVRNVAPNKEMLCITFRIPAAILYKNQTVNRDNHEGPPLKRQRTDKDF

SEQ ID NO: 2239 - protein, 367 aa, Bos taurus
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 2240 - protein, 432 aa, Bos taurus
MAAPVGAQARKLLRDLVLRPPLLAARSQVVQLTSRRWLNLQEYQSKKLMSDNGVKVQRFFVADTANEALEAAKRLNAKEIVLKAQILAGGRGKGVFSSGLKGGVHLTKDPKVVGQLAKQMIGYNLATKQTPKEGVKVKKVMVAEALDISRETYLAILMDRSCNGPVLVGSPQGGVDIEEVAASNPELIFKEQIDIIEGIKDSQAQRMAENLGFLGPLKNQAADQIKKLYNLFLKIDATQVEVNPFGETPEGQVVCFDAKINFDDNAEFRQKDIFAMDDKSENEPIENEAARYDLKYIGLDGNIACFVNGAGLAMATCDIIFLNGGKPANFLDLGGGVKESQVYQAFKLLTADPKVEAILVNIFGGIVNCAIIANGITKACRELELKVPLVVRLEGTNVHEAQNILSNSGLPITSAVDLEDAAKKAVASVAKK

SEQ ID NO: 2241 - protein, 423 aa, Bos taurus
MAAQRVFPLSCVVQQYAWGKMGSNSEVARLLASSDPLAQISEDRPYAELWMGTHPRGDAKILDNRISQKTLGQWIADNQDSLGSKVKDTFNGKLPFLFKVLSVETALSIQAHPNKELAEKLHLQAPQHYPDANHKPEMAIALTPFQGLCGFRPVEEIVTFLTKVPEFQFLIGDNAAAQLKQSLSQDSEAVTSALRSCFSHLMKSEKKVVVEQLNLLVKRISQQVAAGNNMEDICGELLLQLHQQYPGDIGCFAIYFLNLLTLKPGEAMFLEANVPHAYLKGDCVECMACSDNTVRAGLTPKFIDVPTLCEMLSYTPSPSQDRLFPPARSPEDPYLSIYDPPVPDFTVMKVEVPGSVTEYKVLALDSASILLVVQGTVTASSPTAQAAIPLKRGGVLFIGANESVSLKLTVPKDLLMFRACCLL

SEQ ID NO: 2242 - protein, 329 aa, Bos taurus
MVHAKSWTLKKHFVGYPTNSDFELKTVELPPLKDGEVLLEALYLTVDPYMRIMAKSLKEGDMMMGEQVARVVESKNSAFPTGTIVLAPSGWTTHSISNGEKLEKVLAEWPDTLPLSLALGTVGMPGLTAYFGLLDICGVKGGETVLVSAAAGAVGSIVGQIAKLKGCKVVGTAGSDEKVAWLKKHGFDVALNYKTVKSLEEALKEAAPEGYDCYFDNVGGEFSNVAITQMKKFGRIAICGAISVYNRTSPLSPGPSPEIIIFKELHLQGFVVYRWQGEVRQKALRDLLKWVSEGKIQYHEHVTEGFENMPAAFIGLLKGENLGKAIVKA

SEQ ID NO: 2243 - protein, 531 aa, Bos taurus
MAAIKAINSKAEVARAQAALAVNICAARGLQDVLRTNLGPKGTMKMLVSGAGDVKLTKDGNVLLHEMQIQHPTASLIAKVATAQDDITGDGTTSNVLIIGELLKQADLYISEGLHPRIIAEGFEIAKIKALEVLEQVKIKKEMKREIHLDVARTSLQTKVHPQLADVLTEAVVDSVLAIRRPNYPIDLFMVEIMEMKHKSETDTKLIKGLVLDHGARHPDMKKRVDDAFILTCNVSLEYEKTEVSSGFFYKTAEEKEKLVKAERKFIEDRVQKIIDLKDKVCAQSNKGFVVINQKGIDPFSLDALAKHGILALRRAKRRNMERLSLACGGVAVNSVEDLSVDCLGHAGLVYEYTLGEEKYTFIEDCINPRSVTLLVKGPNKHTLTQIKDAVRDGLRAIKNAIEDGCVVPGAGAVEVVIAEALVTYKHTIQGRARLGVQAFADALLIIPKVLAQNSGYDLQETLVKVQAEHSNSKQPVGIDLNTGEPMVAADAGVWDNYCVKKQLLHSCTVIATNILLVDEIMRAGMSSLKG

SEQ ID NO: 2244 - protein, 360 aa, Bos taurus
MALRSMRKARECWNFIRALHQGPDAAPVPQKDAVKRIFSGIQPTGIPHLGNYLGAIESWVRLQDEHDSVLYSIVDLHSITVPQDPTILRQSILDMTAALLACGINPEKSILFQQSQVSEHTQLSWILTCMVRLPRLQHLHQWKAKTAKEKHNGTVGLLTYPVLQAADILLYKSTHVPVGEDQVQHMELVQDLAQSFNKKYGEFFPVPKSILTSMKKVKSLRDPSAKMSKSDPDKLATVRITDSPEEIVQKFRKAMTDFTSEVTYEPASRGGVSNLVAIHAAVAGLPVEEVVRRSAGMDTARYKLVVADAVIEKFAPIKSEIEKLKMNKDHLEKVLQVGSARAKELAYPVCQEVKKLVGFL

SEQ ID NO: 2245 - protein, 266 aa, Bos taurus
MHVNGKVALVTGAAQGIGRAFAEALLLKGAKVALVDWNLEAGVKCKAALDEQFEPQKTLFIQCDVADQEQLRDTFRKVVDHFGKLDILVNNAGVNNEKNWEKTLQINLVSVISGTYLGLDYMSKQNGGEGGININMSSLAGLMPVAQQPVYCASKHGIVGFTRSAAMAANLMNSGVRLNAICPGFVDTPILKSIEKEENMGKYIEYMGPIKDMMKYYGILDPSMIANGLITLIEDDALNGAIMKITTSKGIHFQDYDTTPFHMKMQ

SEQ ID NO: 2246 - protein, 186 aa, Bos taurus
MAGHRLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKS

SEQ ID NO: 2247 - protein, 200 aa, Bos taurus; identical to SEQ ID NO: 1512

SEQ ID NO: 2248 - protein, 113 aa, Bos taurus
KIQYLVYQMLKGLKYIHSAGVVHRDLKPGNLAVNEDCELKILDFGLARHTDVEMTGYVVTRWYRAPEVILSWMHYNQTVDIWSVGCIMAEMLTGKTLFKGKDYLDQLTQILKV

SEQ ID NO: 2249 - protein, 129 aa, Bos taurus
LKGLKYIHSAGVVHRDLKPGNLAVNEDCELKILDFGLARHTDVEMTGYVVTRWYRAPEVILSWMHYNQTVDIWSVGCIMAEMLTGKTLFKGKDYLDQLTQILKVTGVPGAEFVQKLNDKAAKSYIQSLP

SEQ ID NO: 2250 - protein, 334 aa, Bos taurus
MSEPIRVLVTGAAGQIAYSLLYSIGNGSVFGKDQPIILVLLDITPMMGVLDGVLMELQDCALPLLKDVIATDKEEIAFKDLDVAILVGSMPRRDGMERKDLLKANVKIFKCQGAALDKYAKKSVKVIVVGNPANTNCLTASKSAPSIPKENFSCLTRLDHNRAKAQIALKLGVTSDDVKNVIIWGNHSSTQYPDVNHAKVKLQGKEVGVYEALKDDSWLKGEFITTVQQRGAAVIKARKLSSAMSAAKAICDHVRDIWFGTPEGEFVSMGIISDGNSYGIPDDLLYSFPVTIKDKTWKVVEGLPINDFSREKMDLTAKELAEEKETAFEFLASA

SEQ ID NO: 2251 - protein, 373 aa, Bos taurus
MSVPAFIDISEEDQAAELRAYLKSKGAEISEENSEGGLHVDLAQIIEACDVCLKEDDKDVESVMNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLAYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 2252 - protein, 528 aa, Mus musculus
MLNVPSQAFPAPGSQQRVSSQGRSKVPLKQGRSLMDWIRLTKSGKDLTGLKGGLIEVTEEELKKHNKKEDCWICIRGFVYNVSPYMEYHPGGEDELMRAAGADGTDLFNEVHRWVNYESMLKECLVGRMAVKPAVPKDCHEGKRVLNGMLPKSQMSDTLPRDVTDTLPREDLSSPSYDWFQTESSVTIVVYTKQKNISLDSVIVDLQDDSLRAEAVIKDHSYLVHVGLSHEVQENFSVRVIENVGKIEIVLQKKESVSWQCLGDHLEKHDSFIPKKDTGLYYRRCQLISKEDVTHDTRLFCLMLPPSTHLQVPVGQHVYLKLSVTGAEIVKPYTPVSDSLLSDFKEPVLSPNKYICFLIKIYPAGLFTPELDRLQIGDFISVSGPEGDFKVSKLQEVEDLFLLAAGTGFTPMVTVLNYALSHMSSLRKVKLMFFNKTEDDIIWRCQLEKLALREKRFDVEFVLSAPSPEWNGKQGHISRALLSEFLQRSSENSRAFLCICGPTPFTDEGIRLLHDLNFSDDEIHGFTA

SEQ ID NO: 2253 - protein, 113 aa, Mus musculus
LMFAALSGNKDITWVMLEAGAETDVVNSVGRTAAQMAAFVGQHDCVAIINNFFPRERLDYYTKPQGLDKEPKLPPKLAGPLHKIITTTNLHPVKIVMLVSENPLLADAAALGK

SEQ ID NO: 2254 - protein, 300 aa, Mus musculus
MGHIKKGELTQEEKELLEVIGKGTVQEAGRLLSSKNVHVNCLDENGMTPLMHAAYKGKLEMCKLLLRHGADASCHQHEHGYTALMFAALSGNKDITWVMLEAGAETDVVNSVGRTAAQMAAFVGQHDCVAIINNFFPRERLDYYTKPQGLDKEPKLPPKLAGPLHKIITTTNLHPVKIVMLVSENPLLADAAALGKCYRVMDLICEKCMKQRDMNEVLAMKMHYISCIFQKCITFLKEGENKLDTLIRSLLKGRASDGFPVYQEKIIRESIRKFPYCEATLLQQLVRSIAPVEIVRLLFC

SEQ ID NO: 2255 - protein, 113 aa, Mus musculus; identical to SEQ ID NO: 2253

SEQ ID NO: 2256 - protein, 67 aa, Mus musculus
RPLLVLFYATTILVAVPICIWKFQKMKVGMHTKSWFIAGIFLLLTIPVSLWGILQHLVHYTQPELQK

SEQ ID NO: 2257 - protein, 29 aa, Mus musculus
LLVLFYATTILVAVPICIWKFQKMKVGMH

SEQ ID NO: 2258 - protein, 67 aa, Mus musculus; identical to SEQ ID NO: 2256

SEQ ID NO: 2259 - protein, 29 aa, Mus musculus
LLVLFYATTILVAVPICIWKFQKMKVGMH

SEQ ID NO: 2260 - protein, 197 aa, Mus musculus
YQSNIKEDPSAAEAVECWKKYYEIVMLCGLLKMWEDLRLRVHGPFFPRILRRRKGKRDFGKTITHIVAKVMTTDMVKNLSSDTLLQQHNDLNLALDSCYSGDIVVIFPGEYQASNLALLTDDITIKGVGKREEIMITSEPSHDSFVVSKADNVKLMQLSLIQQGTVDGIVVVESGHLTLENCLLKCEGTGVCVLTGA

SEQ ID NO: 2261 - protein, 154 aa, Mus musculus
WKKYYEIVMLCGLLKMWEDLRLRVHGPFFPRILRRRKGKRDFGKTITHIVAKVMTTDMVKNLSSDTLLQQHNDLNLALDSCYSGDIVVIFPGEYQASNLALLTDDITIKGVGKREEIMITSEPSHDSFVVSKADNVKLMQLSLIQQGTVDGIVV

SEQ ID NO: 2262 - protein, 86 aa, Mus musculus
AQAKTLVKKMKSTPTINLQEDWKLITLLIGNNDLCLYCENPEDNSTKEYVKYIQQALDILYEELPRVFINVVEVMELAGLHHVQGG

SEQ ID NO: 2263 - protein, 505 aa, Mus musculus
MGRTRKANVCRRLSRRALGFYARDAGVVQRTNLGILRALVCQESTKFKNVWTTHSKSPIAYERGRIYFDNYRCCVSSVASEPRKLYEMPKCSKSEKIEDALLWECPVGDILPDPSDYKSSLIALTAHNWLLRISATTGEVLEKIYLASYCKFRYLSWDTPQEVIAVKSAQNKGSAAARQAGTSPPVLLYLAVFRVLPFSLVGILEINKKVFENVTDATLSHGILIVMYSSGLVRLYSFQAIIEQFMQQKLDLGCACSQGGTTGTVGEAPFGIPCNVKITDSPPPLFEVSSLENAFQIGGHPWHYIITPNKKKQKGVFHICALKDNSLAKNGIQEMECCSLESDWIYFHPDASGRIIHVGPNQVKVLKLSEVENDSSQHQISEDFVIWAKREDRKENLITVTASGRVVKRNVSLLDDDPEQETFKIVDYEDELDLLSVVAVTQIDAEGKAHLDFHCNEYGTLLKSIPLVESWDVVCIMSGTLSCKGFLYRCHLLDHVHISPDSPVL

SEQ ID NO: 2264 - protein, 953 aa, Mus musculus
MITSAAGIISLLDEEEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDPMETEEKTASAVAGKTPDASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLSMTETCRYQPFKPLSIGGIIILKDTSEDVEELVEPVAAHGPKIEEEEQEPEPPEPFEYIDD

SEQ ID NO: 2265 - protein, 87 aa, Mus musculus
YGLVGSCSDIVMVNSSWTLNHILSLWKVGHCTNIVYPPCDVQTFLDIPLHEKKVTPGHLLVSIGQFRPEKNHALQIKAFAKLLNEKA

SEQ ID NO: 2266 - protein, 31 aa, Mus musculus
LSLWKVGHCTNIVYPPCDVQTFLDIPLHEKK

SEQ ID NO: 2267 - protein, 57 aa, Mus musculus
EALLGTTTVNSIVIWNLKTGQLLKKMHIDDSYQASVCHGAYSEKGLLFVVVSQPCAK

SEQ ID NO: 2268 - protein, 47 aa, Mus musculus
LGTTTVNSIVIWNLKTGQLLKKMHIDDSYQASVCHGAYSEKGLLFVV

SEQ ID NO: 2269 - protein, 384 aa, Mus musculus
MEELSGKPLSYAEKEKLKEKLAFLKKEYSRTLARLQTETADRPACDNLNPGNLQLVSELKNPSSSCSVDVSAMWWERAGAKEPCIVTACEDVVSLWKPLNSLQWEKVHTWHFTEVPVLQIVPVPDVYNLICVALGSLEIREIRALLCSSGDDSEKQVLLKSGDIKAMLGLTKRRLVSSTGTFCNQQIQIMTFADDGSSKDEQLLMPPDETVLTFAEVQGTQEALLGTTTVNSIVIWNLKTGQLLKKMHIDDSYQASVCHGAYSEKGLLFVVVSQPCAKESQALGSPVFQLLVINPKTAQSVGVLLCSLPQGQAGRFLEGDVKDHVAAAVLTSGTIAIWDLLLGHCTALLPPVSDQSWSLVKWSGTDSHLLAGQKDGNIFIYRYF

SEQ ID NO: 2270 - protein, 471 aa, Mus musculus
MEFDCEGVRRLLGKYKFRDLTVEELKNVSVSFPHFRYSVDTYVFKDTSQKDLLNFTGTIPVMYQGKTYNIPIRFWILDSHPFAPPICFLKPTANMEISVGKHVDAKGRIYLPYLQNWSHPKSAIVGLIKEMIAKFQEELPLYSIPSSNEAQQVDLLAYITKITEGVSDINSRGWTNHENKILNKITVVGSGDLGIACTLAISAKGIADKLLLLDLSDGMSQGTMDLDIFNLPNVEISKDLSASAHSKVVIFTANSLGGSESYLHAVQSNVDMFRALVPALGHYSQHAVLLVASQPVEIMSYVTWKLSTFPATRVVGIGCNLDSQRLQYIITSVLKVQTSGKEVWVVGEQGENKVCSWSGRDGVLSPSSQAQLSSRAMELLKVKGQRSWSVGLSVADLVDTIINNKRKVHSVSTLAKGYYGLDNEVFLSLPCILGTGGVSEVIKTKAGEDTVTGTLQASASSIHALQQQLEL

SEQ ID NO: 2271 - protein, 77 aa, Mus musculus
DLPIRNVNLAQSVAMITIGEVVGFVTPLMIVLYCTWKTALSLQNKYPISQHLGEKKKALKMILTCAGVFLVCFVPYH

SEQ ID NO: 2272 - protein, 67 aa, Mus musculus
ITIGEVVGFVTPLMIVLYCTWKTALSLQNKYPISQHLGEKKKALKMILTCAGVFLVCFVPYHFSFPL

SEQ ID NO: 2273 - protein, 141 aa, Mus musculus
CNETEDGQVPHSLETLYQSAGCSNISDALIVLVHLLMLESGYIPQGTETKAVTMPEKWKSSGVYKLQYTHPLCEGGFAVLTCVPLGNLIIINATIKVNGGIKNVKSVQLQPGSYVAAGVEPGESAAKVYKDLKKLSRLFKD

SEQ ID NO: 2274 - protein, 72 aa, Mus musculus
VLVHLLMLESGYIPQGTETKAVTMPEKWKSSGVYKLQYTHPLCEGGFAVLTCVPLGNLIIINATIKVNGGIK

SEQ ID NO: 2275 - protein, 121 aa, Mus musculus
APILSVLASCVQGASVVSCLCVWIVTSVEDKVAAEAMGHIQISVEDHHWSLKDLSIIWRTVLTRRKSHTLIRGFQLFIKDSPLLLIMEMYELCMFFKNYEKAKVKLLEFQKSLETLDTVAA

SEQ ID NO: 2276 - protein, 104 aa, Mus musculus
VVSCLCVWIVTSVEDKVAAEAMGHIQISVEDHHWSLKDLSIIWRTVLTRRKSHTLIRGFQLFIKDSPLLLIMEMYELCMFFKNYEKAKVKLLEFQKSLETLDTV

SEQ ID NO: 2277 - protein, 104 aa, Mus musculus
KLMSIMGNVLRFLPAFVRMKQLIEEGYVGELLVCEVQVHSGSLLGKKYNWSCDDLMGGGGLHSVGTYIIDLLTFLTGQKAVKVHGLLKTFVKQTDHIKGIRQIT

SEQ ID NO: 2278 - protein, 195 aa, Mus musculus
VIIPLLKDEGFAVKALWGRTQEEAEELAKEMSVPFYTSRIDEVLLHQDVDLVCINLPPPLTRQIAVKTLGIGKNVICDRTATPLDAFRMMSAAHYYPKLMSIMGNVLRFLPAFVRMKQLIEEGYVGELLVCEVQVHSGSLLGKKYNWSCDDLMGGGGLHSVGTYIIDLLTFLTGQKAVKVHGLLKTFVKQTDHIK

SEQ ID NO: 2279 - protein, 34 aa, Mus musculus
VSKWDLVCDNTWKVHIAKFSLLVGLIFGYLITGC

SEQ ID NO: 2280 - protein, 80 aa, Mus musculus
LMATQQFESAKKLILYLTQKNCVSPESDIKGVMPELEKELSRRPKKVCIVKVVGTRNLWKNIVVLCVNSLTGYGIHHCFA

SEQ ID NO: 2281 - protein, 351 aa, Mus musculus
MAAAPLKVCIVGSGNWGSAVAKIIGSNVKTLQKFSSTVKMWVFEETVNGRKLTDIINNDHENVKYLPGHKLPENVVAVPNLSEAVQDADLLVFVIPHQFIHKICDEITGRVPEKALGITLIKGIDEGPDGLKLISDIIREKMGIDISVLMGANIASEVAAEKFCETTIGSKVMQNGLLFKELLQTPNFRITVVDDADTVELCGALKNIVAVGAGFCDGLRCGDNTKAAVIRLGLMEMIAFAKIFCKGQVSTATFLESCGVADLITTCYGGRNRRVAEAFARTGKTIEELEKELLNGQKLQGPQTSAEVYRILRQKGLLDKFPLFTAVYQICYEGRPVTQMLSCLQSHPEHI

SEQ ID NO: 2282 - protein, 320 aa, Mus musculus
MAAAPLKVCIVGSGNWGSAVAKIIGSNVKTLQKFSSTVKMWVFEETVNGRKLTDIINNDHENVKYLPGHKLPENVVAVPNLSEAVQDADLLVFVIPHQFIHKICDEITGRVPEKALGITLIKGIDEGPDGLKLISDIIREKMGIDISVLMGANIASEVAAEKFCETTIGSKVMQNGLLFKELLQTPNFRITVVDDADTVELCGALKNIVAVGAGFCDGLRCGDNTKAAVIRLGLMEMIAFAKIFCKGQVSTATFLESCGVADLITTCYGGRNRRVAEAFARTGKTIEELEKELLNGQKLQGPQTSAEVYRILRQKGLLDK

SEQ ID NO: 2283 - protein, 770 aa, Mus musculus
MDFSKFLADDFDVKDWINAAFRAGPKDGAAGKADGHAATLVMKLQLFIQEVNHAVEETSLQALQNMPKVLRDVEALKQEASFLKEQMILVKEDIKKFEQDTSQSMQVLVEIDQVKSRMQLAAESLQEADKWSTLSADIEETFKTQDIAVISAKLTGMQNSLMMLVDTPDYSEKCVHLEALKNRLEALASPQIVAAFTSQSVDQSKVFVKVFTEIDRMPQLLAYYYKCHKVQLLATWQELCQSDLPLDRQLTGLYDALLGAWHTQTQWATQVFKNPHEVVTVLLIQTLGALVPSLPMCLSAAVERAGPELELTRLLEFYDTTAHFAKGLEMALLPHLQDHNLVKVVELVDAVYGPYKPFQLKYGDMEENNLLIQISAVPLEHGEVIDCVQELSHSVHKLFGLASAAVDRCAKFTNGLGTCGLLTALKSLFAKYVSHFTNALQSIRKKCKLDDIPPNSLFQEDWTAFQNSVRIIATCGELLRQCGDFEQQLANRILSTAGKYLSDSYSPRSLAGFQDSILTDKKSPAKNPWQEYNYLQKDNPAEYASLMEILYTLKEKGSSNHNLLSASRTALTRLNQQAHQLAFDSVFLRIKQQLLLVSRMDSWNTAGIGETLTDDLPAFSLTPLEYISNIGQYIMSLPLNLEPFVTQEDSALELALHAGKLPFPPEQGDELPELDNMADNWLGSIARATMQTYCDVILQIPEVTPHSTKQLATDIDYLINVMDALGLQPSRTLQNIAALLKAKPEEYRQVSKGLPRRLAATVATMRGVNY

SEQ ID NO: 2284 - protein, 92 aa, Mus musculus
VTRCYEVVMNVIHQLAALYISNKIGPKIIETTGVHFQTMYEHLGELLTVLLTLDEIVDNHVTLKDHWTMYKRLLKSVHHNPSKFGIQEEKLK

SEQ ID NO: 2285 - protein, 184 aa, Mus musculus
DDLIGDVWDFNLDPIALKLLPYEQSSLLELIKTENKVLNKVITVYAALCCEIKKLKYEAETKFYNGLLFYGEGATDSSMVEGDCQIQMGRFVSFLQELSCFVTRCYEVVMNVIHQLAALYISNKIGPKIIETTGVHFQTMYEHLGELLTVLLTLDEIVDNHVTLKDHWTMYKRLLKSVHHNPSK

SEQ ID NO: 2286 - protein, 922 aa, Mus musculus
MFLHSVNLWNLAFYVFMVFLATLGLWDVFFGFEENKCSMSYMFEYPEYQKIELPKKLTKRYPAYELYLYGEGSYAEEHKILPLTGIPVLFLPGNAGSYKQVRSIGSIALRKAEDIDFKYHFDFFSVNFNEELVALYGGSLQKQTKFVHECIKAILKLYKGQEFAPTSVAIIGHSMGGLVARALLTLKNFKQDLINLLVTQATPHVAPVMPLDRFITEFYMNVNNYWILNARHINLTTLSVAGGFRDYQVRSGLTFLPKLSHYTSALSVVSSAVPKTWVSTDHLSIVWCKQLQLTTIRAFFDLIDADTKQITQKPKKKLSVLNHHFIRHPAKQFEENPSIISDLTGTSMWVPVKVSRWSYVAYNESDKIYFAFPLANHRKIYTHAYCQSTMLDTNSWIFGCINSTSMCRQGVDLSWKAELLPTIKSLTLRLQDYPSLSHIVVYVPSVHGSKFVVDCEFFKKEARSMQLPVTHLFSFGLSSRKVTLNTNGLYYNIELLNFGQIYQAFKVNVVSKCTGSKEEITSIYKLHIPWSYEDSLTIAQVPSSTDISLKLHVAQPENDSHVALLKMYTSSDCQYEVTIKTSFPQILGQVVRFHGGALPAYVVSSILLAYGGQLYSLLSTGYCLEYSTILDKEAKPYKVDPFVIMIKFLLGYKWFKELWDAVLLPELDAIVLTSQSMCFPLVSLILFLFGTCTAYWSGLLSSTSVQLLSSLWLALKRPAELPKDIKVMSPDLPVLTVVFLIVSWTTCGALAILLSYLYYVFKVVHLQASLTTFKNNQPVNPKHSRRSEKKSNHHKDSAVQSLRLCANDAEDSLRMHSTVINLLTWVVLLSMPSLIYWLKNLRYYFKLSPDPCKPLAFLLIPAIAILGNTHTVSVKSSKLLKTVSQFPLPLAVGVIAFGSSHLYRVPCFVIIPLVFHALCNFM

SEQ ID NO: 2287 - protein, 87 aa, Mus musculus
QGFAGPVTLDDSGDIDNIMSLLYVSLDTRKYKVLMKYDTHKNKTIPVAENPNFIWKNHKLPNDVPGLGPQILMIAVFTLTGILVVLL

SEQ ID NO: 2288 - protein, 68 aa, Mus musculus
MSLLYVSLDTRKYKVLMKYDTHKNKTIPVAENPNFIWKNHKLPNDVPGLGPQILMIAVFTLTGILVVL

SEQ ID NO: 2289 - protein, 87 aa, Mus musculus; identical to SEQ ID NO: 2287

SEQ ID NO: 2290 - protein, 68 aa, Mus musculus; identical to SEQ ID NO: 2288

SEQ ID NO: 2291 - protein, 127 aa, Mus musculus
IELIPVHLESQVPRSNLDSFQLTVDKLKLALTQAKKKAKKVKGLVLINPQNPLGDVYTQSSLQEYLVFAKTHKLHVIMDEIYMLSVFEPSVTFHSVLSIKDLPDPNMTHMIWGTSKDFGMSGIRFGV

SEQ ID NO: 2292 - protein, 141 aa, Mus musculus
IELIPVHLESQVPRSNLDSFQLTVDKLKLALTQAKKKAKKVKGLVLINPQNPLGDVYTQSSLQEYLVFAKTHKLHVIMDEIYMLSVFEPSVTFHSVLSIKDLPDPNMTHMIWGTSKDFGMSGIRFGVLYTHNKEVASAMKA

SEQ ID NO: 2293 - protein, 127 aa, Mus musculus; identical to SEQ ID NO: 2291

SEQ ID NO: 2294 - protein, 141 aa, Mus musculus; identical to SEQ ID NO: 2292

SEQ ID NO: 2295 - protein, 169 aa, Mus musculus
LKATLPCYKLDCPSSLQLPMCALGDTVETWFCLNNVGDLPTFFTWEVPAPFQILPTTGLLEPGLGCKIKVTFEPLIAVIHEVEALCWYGKGNKQKNSINIQAAAKCAQLLVSIKHKGLEDQDQEGFQKVVHFGYVSVGSVAERQIRLYNPSAVNAPFKIEMAEHVLTKD

SEQ ID NO: 2296 - protein, 34 aa, Mus musculus
TGLLEPGLGCKIKVTFEPLIAVIHEVEALCWYGK

SEQ ID NO: 2297 - protein, 47 aa, Mus musculus
DIQLCPSPGTVLFNTVHKPWSDVIPCTYEMKHTLKELIRVKAFLLAG

SEQ ID NO: 2298 - protein, 31 aa, Mus musculus
WSDVIPCTYEMKHTLKELIRVKAFLLAGTTV

SEQ ID NO: 2299 - protein, 47 aa, Mus musculus; identical to SEQ ID NO: 2297

SEQ ID NO: 2300 - protein, 41 aa, Mus musculus
VLFNTVHKPWSDVIPCTYEMKHTLKELIRVKAFLLAGTTIL

SEQ ID NO: 2301 - protein, 72 aa, Mus musculus
ISPNWLCFHASLFGKDIKVVIPVVSVQLIKKHKMARLLPNGLAITTNTSQKYVFVSLLSRDSVYDMLRRVCT

SEQ ID NO: 2302 - protein, 64 aa, Mus musculus
PNWLCFHASLFGKDIKVVIPVVSVQLIKKHKMARLLPNGLAITTNTSQKYVFVSLLSRDSVYDM

SEQ ID NO: 2303 - protein, 76 aa, Conus marmoreus
MKLTCVIVAVLFLTAWTFVTADDSGNGLENLFSKAHHEMKNPKDSKLNKRCLDGGEICGILFPSCCSGWCIVLVCA

SEQ ID NO: 2304 - protein, 417 aa, Bos taurus
MPLYEGLGSGGEKTAVVIDLGEAFTKCGFAGETGPRCIIPSVIKKAGMPKPIRVVQYNINTEELYSYLKEFIHILYFRHLLVNPRDRRVVVIESVLCPSHFRETLTRVLFKYFEVPSVLLAPSHLMALLTLGINSAMVLDCGYRESLVLPIYEGIPVLNCWGALPLGGKALHKELETQLLEQCTVDTGAAKEQSLPSVMGSIPEGILEDIKVRTCFVSDLKRGLNIQAAKFNIDGNTERPSPPPNVDYPLDGEKILHVLGSIRDSVVEILFEQDNEEKSVATLILDSLMQCPIDTRKQLAENLVVIGGTSMLPGFLHRLLAEIRYLVEKPKYKKTLATKTFRIHTPPAKANCVAWLGGAIFGALQDILGSRSVSKDYYNQTGRIPDWCSLNNPPLEMMFDVGKNQPPLMKRAFSTEK

SEQ ID NO: 2305 - protein, 135 aa, Bos taurus
MFLVGLTGGIASGKSSVIQVFQQLGCAVIDVDIIARHIVQPGYPAHRRIVEAFGTEVLLENGDIDRKVLGDLIFNQPDRRHLLNSITHPEICKEMMKETFKYFLRGYRYVILDIPLLFETKKLLKYMKHTVVVYW

SEQ ID NO: 2306 - protein, 353 aa, Bos taurus
MPLVCLTDFREHAREHLSKSTWDFIEGGADDCCTRDENMAAFKKIRLRPRYLKDVSKVDMRTTIQGAEISAPICIAPTGFHRLAWPDGEMSTARAAQAASICYITSTYASCSLEDIVAAAPRGLRWFQLYVHPNRQINKQMIQKVESLGFKALVITVDVPKVGNRRNDITNQVDLMKKLLLKDLGSPEMGNVMPYFQMSPIDPSICWEDLSWFQSMTRLPIILKGILTKEDAELAVKHNVHGIIVSNHGGRQLDEVPASIDALTEVVAAVKGKVEVYLDGGIRTGNDVLKALALGAKCVFVGRPILWGLAYKGEHGVKEVLDILKNEFHTSMTLTGCRSVAEINQDLIQFSRL

SEQ ID NO: 2307 - protein, 65 aa, Bos taurus
DVLKALALGAKCVFVGRPILWGLAYKGEHGVKEVLDILKNEFHTSMTLTGCRSVAEINQDLIQFS

SEQ ID NO: 2308 - protein, 50 aa, Bos taurus
LGAKCVFVGRPILWGLAYKGEHGVKEVLDILKNEFHTSMTLTGCRSVAEI

SEQ ID NO: 2309 - protein, 224 aa, Bos taurus
MSHTEVKLKVPFGNKLLDAVCLVPNKSLTYGVILTHGASGDMNLPHLTSLASHLASHGFFCLRFTCKGLNIVHRIKAYKSVLNYLKTSEYKLAGVFLGGRSMGSRAAASVLCHIEPDDADDFVRGLICISYPLHHPKQQHKLRDEDLFRIKDPVLFVSGSADEMCEKNLLEKVAQKMQAPHKIHWIEKANHSMAVKGRSTNDVFKEINTQILFWIQEITETDKK

SEQ ID NO: 2310 - protein, 475 aa, Bos taurus
MSALTTLFKYVDENQDRYVKKLAEWVAIQSVSAWPEKRGEIRRMMEVAAADIKQLGGSVQLVDIGTQKLPDGSEIPLPPILLGKLGSDPQKKTVCIYGHLDVQPAALEDGWDSEPFTLVERDGKLFGRGATDDKGPVAGWINALEAFQKTKQEVPVNVRFCLEGMEESGSEGLDALIFAQKDAFFKDVDYVCISDNYWLGKNKPCITYGLRGICYFFIEVECSDKDLHSGVYGGSVHEAMTDLIMLMGCLMDKKGKILIPGISEAVAPVTEEELELYDKIDFDLEEYARDVGAGTLLHGCKKDILMHRWRYPSLSLHGIEGAFSGSGAKTVIPRKVVGKFSIRLVPNMTPEVVSEQVTSYLTKKFAELHSPNKFKVYMGHGGKPWVSDFNHPHYLAGRRALKTVFGVEPDLTREGGSIPVTLTFQEATGKNVMLLPVGSADDGAHSQNEKLNRRNYIEGTKMLAAYLYEVSQLKD

SEQ ID NO: 2311 - protein, 142 aa, Bos taurus
LHSGVYGGSVHEAMTDLIMLMGCLMDKKGKILIPGISEAVAPVTEEELELYDKIDFDLEEYARDVGAGTLLHGCKKDILMHRWRYPSLSLHGIEGAFSGSGAKTVIPRKVVGKFSIRLVPNMTPEVVSEQVTSYLTKKFAEL

SEQ ID NO: 2312 - protein, 138 aa, Bos taurus
AMTDLIMLMGCLMDKKGKILIPGISEAVAPVTEEELELYDKIDFDLEEYARDVGAGTLLHGCKKDILMHRWRYPSLSLHGIEGAFSGSGAKTVIPRKVVGKFSIRLVPNMTPEVVSEQVTSYLTKKFAELHSPNKFKV

SEQ ID NO: 2313 - protein, 548 aa, Bos taurus
MALHVPKAPGFAQMLKEGAKHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRLGLSVSEVIEGYEIACKKAHEILPDLVCCSAKNLRDVDEVSSLLHTSVMSKQYGNEVFLAKLIAQACVSIFPDSGHFNVDNIRVCKILGSGVHSSSVLHGMVFKKETEGDVTSVKDAKIAVYSCPFDGMITETKGTVLIKSAEELMNFSKGEENLMDAQVKAIADTGANVVVTGGRVADMALHYANKYNIMLVRLNSKWDLRRLCKTVGATALPRLNPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGVLDTYLGKYWAIKLATNAAVTVLRVDQIIMAKPAGGPKPPSGKKDWDEDQND

SEQ ID NO: 2314 - protein, 308 aa, Bos taurus
MASSPTVLMRLVASAYSIAQKAGTIVRRVIAEGDLGIIEKTCATDLQTKADRLVQVSICSSLARKFPKLTIIGEEDLPPEDVDQELIEDGQWEEILKQPCPSQYSAIKEEDLVVWVDPLDGTKEYTEGLLDNVTVLIGIAYEGKAIAGVINQPYYNYQAGPDAVLGRTIWGVLGLGAFGFQLKEAPAGKHIITTTRSHNSQLVTDCITAMNPDDVLRVGGAGNKIIQLIEGKASAYVFASPGCKKWDTCAPEVILHAVGGKLTDIHGNALQYNKEVKHMNSAGVLATLRNYDYYASRVPQSVKNALVP

SEQ ID NO: 2315 - protein, 695 aa, Mus musculus
MSSFKGNQAQKRRLSVFPKGPLEIPSPTEADWPKDDEKDFVFKDLDQELDSLPQPYRMINKLVDHLFNRSWEIIEERDSLREVEKNWIVPAIYHPVAEIQLDKMPGGMAVSHDYLFIGGLKGFSIYNLHNCKRIYVLEKFKADVISIWATDLGNDVLIVPIDEMGIVRLFYLCKDSLYHIKAINEVDDSSKQSTCLKMEISQNGDFAAFLFQGAGDVWLEVYKLPKEIWLKEMEHPQSTLNQKKKAKQLQLSTPDSAVTESIETSSGPSVSSNSVQDLNISFKSDLKLSLPVFVMKIKPPKPIAGTTFKSPLEVFAKVEDYVGLGSGQNHFIKDVQWEQHMETFYASYKKHLEGEWEEEPLSMATFHFFYTNSLTTMSMDVKSSSGIACVLGIHWNGRHNLFFYSLNKTQKDKTEYENVWPCAAPIVMSQISSFSSYLALVCEDGVLILWDLAEGFLFGVVALPEGCFCQSIHFLRFFLVHEGQNVYPDYPVKFEVMCVVLCTDASLHLVTASGTQGPTSKVLVGRPVMHMEEAICAVAPVPALPGMVLIFSRSQSVTLMDVAKAEVLCAFSAPTCHPQALPWKPLFAVSPHHPYFLLHGAHPHGQTTSTEDPKKSTDSVFYFNFEDYLLLKDISKKCTISQMAVNFSQMLPVEKRCEQVFQKSIQMTKTQMKGREQWSRLRKYSIMLQKELLKR

SEQ ID NO: 2316 - protein, 84 aa, Parthenium argentatum
VMEQAEKLGVPKDEAVHNILFAVCFNTFGGVKILFPNTLKWIGLAGENLHTQLAEEIRGAIKSYGDGNVTLEAIEQMPLTKSVV

SEQ ID NO: 2317 - protein, 76 aa, Solanum lycopersicum
FVNLMEGHIWIESEGLGKGSTAIFIIKLGIPGRANESKLPFVTKLPANHTQMSFQGLKVLVMDENGVSRMVTKGLL

SEQ ID NO: 2318 - protein, 82 aa, Solanum lycopersicum
KKSAVFPYRWVLVQFGAFIVLCGATHLINLWTFNMHTRNVAIVMTTPKALTALVSCITALMLVHIIPDLLSVKTRELFLKKK

SEQ ID NO: 2319 - protein, 389 aa, Solanum tuberosum
MVTVEEYRKAQRAEGPATILAIGTSTPSNCVDQSTYPDYYFRITNSEHKTELKEKFKRMCDKSMIKKRYMHLTEEILKENPNMCAYMAPSLDARQDIVVVEVPKLGKEAAQKAIKEWGQPKSKITHLVFCTTSGVDMPGCDYQLAKLLGLRPSVKRLMMYQQGCFVGGTVLRLAKDLAENNKGARVLVVCSEITAVTFRGPSESHLDSLVGQALFGDGAAAIIMGSDPIIGVERPLFELVSAAQTLVPDSEGAIDGHLREVGLTFHLLKDVPGLISKNIEKSLLEAFQPLGISDWNSLFWIAHPGGPAILDQVELKLGLKQEKLRATREVLSNYGNMSSACVLFILDEMRKASTNEGLGTTGEGLEWGVLFGFGPGLTVETVVLHSVAT

SEQ ID NO: 2320 - protein, 294 aa, Vigna aconitifolia
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEETWPGVTALPDFKSTFPKWPPKDLATVVPNLDAAGLNLLSSMLCLDPSKRITARIAVEHEYFKDIKFVP

SEQ ID NO: 2321 - protein, 320 aa, Arabidopsis thaliana
MVKATKAEKKIAYDTKLCQLIDEYTQILVVAADNVGSTQLQNIRKGLRGDSVVLMGKNTMMKRSVRIHSENTGNTAILNLLPLLQGNVGLIFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATEYTFPQAEKVKEYLKDPSKFAVASVAAVSADAGGGAPAAAKVEEKEESDEEDYGGDFGLFDEE

SEQ ID NO: 2322 - protein, 561 aa, Arabidopsis thaliana
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVAMKEEAAGEVPVAFVVKSKDSELSEDDVKQFVSKQVVFYKRINKVFFTESIPKAPSGKILRKDLRAKLANGL

SEQ ID NO: 2323 - protein, 490 aa, Arabidopsis thaliana
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVA

SEQ ID NO: 2324 - protein, 476 aa, Arabidopsis thaliana
MSAMEALILQLHEIGAVKFGNFKLKSGIFSPVYIDLRLIVSYPSLLTQISQTLISSLPPSATFDVVCGVPYTALPIATVVSVSNGIPMLMRRKEIKDYGTSKAIEGIFEKDQTCLIIEDLVTSGASVLETAAPLRAVGLKVSDAVVLIDRQQGGRENLAENGIKLHSMIMLTDMVRVLKEKGKIEVEVEVNLLKFLEENRRVSVPSVEKPKPKPRVLGFKERSELSKNPTGKKLFDIMLKKETNLCLAADVGTAAELLDIADKVGPEICLLKTHVDILPDFTPDFGSKLRAIADKHKFLIFEDRKFADIGNTVTMQYEGGIFKILEWADIINAHVISGPGIVDGLKLKGMPRGRGLLLLAEMSSAGNLATGDYTAAAVKIADAHSDFVMGFISVNPASWKCGYVYPSMIHATPGVQMVKGGDALGQQYNTPHSVITERGSDIIIVGRGIIKAENPAETAHEYRVQGWNAYLEKCSQ

SEQ ID NO: 2325 - protein, 703 aa, Bromheadia finlaysoniana
MEVSKENGLCLQGRDPLNWGAAAAELQGSHLDEVKKMVEEFRRPVVKLEGVKLKISQVAAVAFGGGASAVELAESARAGVKASSDWVLESVDKGTDSYGVTTGFGATSHRRTKQGGALQKELIKFLNAGIFGSGNSNTLPSAATRAAMLVRINTLLQGYSGIRFEILKAIATLLNKNITPCLPLRGTITASGDLVPLSYLAGILTGRPNSKARTPNGSTVDATTAFRLAGISSGFFDLQPKEGLALVNGTAVGSGVASIVLFETNILAVMAELLSALFCEVMQGKPEFTDHLTHKLKHHPGQIEAAAVMEHILEGSSYMKMAKKLHEMDPLQKPKQDRYALRTSPQWLGPQIEVIRAATKSIEREINSVNDNPLIDVSRNKALHGGNFQGTPIGVSMDNTRLAIAAIGKLMFAQFSELVNDFYNNGLPSNLSSGRNPSLDYGFKGAEIAMASYCSELQALANPVTNHVQSAEQHNQDVNSLGLISSRKTAEAVDILKLMSTTFLVGLCQAVDLRHLEENLKNAVKNTVSQVAKRVLTMGVNGELHPSRFCEKDLIKVIDREYVFAYADDPCSSTYPLMQKLRAVIVEHALNNGVKEKDSNTSIFQKISSFENELKAALPKEVEAARAEFENGSPAIENRIKDCRSYPLYKFVKEVGSGFLTGEKVVSPGEEFDKVFNAICEGKAIDPMLDCLKEWNGAPLPIC

SEQ ID NO: 2326 - protein, 134 aa, Cucumis melo
PLKEMKADWHACLDNRVGFKGFAIPKEAQVKVAEFNFHGSPAQLRHGDVVIAAITSCTNTSSSVMLGAALVAKKACELGLEVKPWIKTVLLQALGVVTKYLAKSGLQKYLNQLGFNIVGYGCTTCIGNSGDIDE

SEQ ID NO: 2327 - protein, 765 aa, Catharanthus roseus
MASHIVGYPRMGPKRELKFALESFWDKKSSAEDLQKVAADLRSSIWKQMADAGIKYIPSNTFSYYDQVLDTATMLGAVPPRYNFAGGEIGFDTYFSMARGNASVPAMEMTKWFDTNYHYIVPELGPEVNFSYASHKAVNEYKEAKELGVDTVPVLVGPVTFLLLSKPAKGVEKTFPLLSLLDKILPVYKEVIGELKAAGASWIQFDEPTLVLDLESHQLEAFTKAYSELESTLSGLNVIVETYFADIPAETYKILTALKGVTGFGFDLVRGAKTLDLIKGGFPSGKYLFAGVVDGRNIWANDLAASLSTLQSLEGIVGKDKLVVSTSCSLLHTAVDLVNEPKLDKEIKSWLAFAAQKVVEVNALAKALAGEKDEAFFSENAAAQASRKSSPRVTNQAVQKAAAALRGSDHRRATTVSARLDAQQKKLNLPVLPTTTIGSFPQTLELRRVRREYKAKKISEDDYVKAIKEEISKVVKLQEELDIDVLVHGEPERNDMVEYFGEQLSGFAFTANGWVQSYGSRCVKPPIIYGDVSRPNPMTVFWSQTAQSMTKRPMKGMLTGPVTILNWSFVRNDQPRFETCYQIALAIKDEVEDLEKAGINVIQIDEAALREGLPLRKAEHAFYLDWAVHSFRITNLPLQDTTQIHTHMCYSNFNDIIHSIIDMDADVMTIENSRSSEKLLSVFREGVKYGAGIGPGVYDIHSPRIPSTEEIADRINKMLAVLDTNILWVNPDCGLKTRKYAEVKPALENMVSAAKLIRTQLASAK

SEQ ID NO: 2328 - protein, 281 aa, Limnanthes alba
MAKTRTSSLRNRRQLKTAVAATADDDKDGIFMVLLSCFKIFVCFAIVLITAVAWGLIMVLLLPWPYMRIRLGNLYGHIIGGLVIWLYGIPIEIQGSEHTKKRAIYISNHASPIDAFFVMWLAPIGTVGVAKKEVIWYPLLGQLYTLAHHIRIDRSNPAAAIQSMKEAVRVITEKNLSLIMFPEGTRSGDGRLLPFKKGFVHLALQSHLPIVPMILTGTHLAWRKGTFRVRPVPITVKYLPPINTDDWTVDKIDDYVKMIHDIYVRNLPASQKPLGSTNRSK

SEQ ID NO: 2329 - protein, 281 aa, Limnanthes douglasii
MAKTRTSSLRNRRQLKPAVAATADDDKDGVFMVLLSCFKIFVCFAIVLITAVAWGLIMVLLLPWPYMRIRLGNLYGHIIGGLVIWIYGIPIKIQGSEHTKKRAIYISNHASPIDAFFVMWLAPIGTVGVAKKEVIWYPLLGQLYTLAHHIRIDRSNPAAAIQSMKEAVRVITEKNLSLIMFPEGTRSRDGRLLPFKKGFVHLALQSHLPIVPMILTGTHLAWRKGTFRVRPVPITVKYLPPINTDDWTVDKIDDYVKMIHDVYVRNLPASQKPLGSTNRSN

SEQ ID NO: 2330 - protein, 328 aa, Solanum lycopersicum
MAVNGASSSGLIVSFGEMLIDFVPTVSGVSLAEAPGFLKAPGGAPANVAIAVTRLGGKSAFVGKLGDDEFGHMLAGILKTNGVQAEGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKGGA

SEQ ID NO: 2331 - protein, 461 aa, Nicotiana tabacum [sequence omitted]

SEQ ID NO: 2332 - protein, 481 aa, Nicotiana tabacum
MASATASHTLCGIPATSSSTTNKAIAPSSARFLAKTPLRRLGFAGAAADSLFTNHVATKLRSLKSSSKPIRGVASMAKKSVGDLTAAELKGKKVFVRADLNVPLDDNQNITDDTRIRAAVPTIKHLMANGAKVILSSHLGRPKGVTPKYSLAPLVPRLSELLGIQVVKVEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSVKTFNDALDTTKTVIWNGPMGVFEFDKFAVGTEAIAKKLADLSGKGVTTIIGGGDSVAAVEKVGVASVMSHISTGGGASLELLEGKVLPGVIALDEADAPVAV

SEQ ID NO: 2333 - protein, 401 aa, Nicotiana tabacum
MAVKKSVGSLKEADLKGKRVFVRVDLNVPLDENFNITDDTRIRAAVPTIKYLMQHGSHVILASHLGRPKGVTPKYSLKPLVPRLSELLGVEVKIANDSIGPEVEKLVAEIPEGGVLLLENVRFYKEEEKNEPEFAKKLASLADLYVNDAFGTAHRAHASTEGVAKYLKPAVAGFLMQKELDYLVGAVANPQKPFAAIVGGSKVSSKIGVIESLLEKVDVLLLGGGMIFTFYKAQGYAVGSSLVEEDKLDLATSLMEKAKAKGVSLLLPTDVVIADKFAADANSKVVPASEIPDGWMGLDIGPDAIKSFGSALDTTKTVIWNGPMGVFEFDKFAAGTEAIAKKLAELSGKGVTTIIGGGDSVAAVEKVGLAEKMSHISTGGGASLELLEGKPLPGVLALDDA

SEQ ID NO: 2334 - protein, 446 aa, Oryza sativa
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 2335 - protein, 544 aa, Pisum sativum
FVLNYLNTTTIAFISLISLLFFLFRFSKVSHTKEPPIISGSWPLLGHLPLMRNTQTPHKTLGALVDKYGPIFTIKLGATNALVLSNWELAKECFTKNDIVVSSRPKPVAVELMSYNQAFIGWAPYGAYWRQLRKIVTLEILSNRRIELLSHIRVSEVQTSIKELVNVWSNQISSQYGLLDDTKSSSTNDEPSTTDYVSVELKKWFAQLTLNMVLRMVVGKRCFGDVDVENKEEAKRFLENIRDFMRLIGTFTVGDGVPFLKWLDLGGHEKEMKKCAKKFDVMLNEWLEEHREKKGLGSEDKVVGERDFMDAMLLVLKDKPIEGFDVDTIIKATTLELILGGSDTTAGTLTWAMCLLLKHPHVLEKLKEELNTYIGKERCVNESDINKLVYLHAIIKETLRLYPPAPFSSPREFTEDCTIGGYHIKKGTRLMPNLWKIHRDPSVWPDPLEFKPERFLSTHKDVDVRGQNFELLPFGSGRRMCAGMSLGLHMVHYILANFLHSFEILNPSPESIDVTEVLEFVTTKATPLEVLVKPCLSFKCYESM

SEQ ID NO: 2336 - protein, 354 aa, Stylosanthes humilis
MASSKAFGWAAKDASGHLSPFHFTRRQNEADDVTLKILYCGVCHSDLHTVKNDWGFTTYPVVPGHEIAGIVTKVGSNVTKFKEGDRVGVGVIVDSCQECECCQQDLESYCPKPVFTYNSPYKGTRTQGGYSDFVVVHQRFVLQFPDNLPLDAGAPLLCAGITVYSPMKYYGMTEPGKHLGVAGLGGLGHVAIKFGKAFGLKVTVISSSPNKESEAIDVLGADSFLLSSDPEKMKAATGTMDYIIDTISAVHSLVSLLGLLKLNGKLVTVGLPSKPLQLPIFPLVAGRKLIGGSNFGGLKETQEMLDFCGKHNIAANIELIKMDEINTAIERLSKADVKYRFVIDVANSLSSSNM

SEQ ID NO: 2337 - protein, 241 aa, Stellaria longipes
MLTKTMGNFFTEVKDTGLLQSEQLHQYILDTSVFPRESEHLKELRKATESHPMSFMGTSPLAGQLLSFMLKTVKPKKTIEVGVFTGYSLLATALSIPDDGKITAVDIDREAYNVGLALIKKAGVESKISFIVSDAMTLLDDLLADGRYQGSYDFAFVDADKTNYVNYHERLIELVKVGGIIAYDNTLWGGTVALPESEVPDFMKNNWVCVTKLNEILGSDARIDIAHLPVGDGITFCRRVY

SEQ ID NO: 2338 - protein, 389 aa, Solanum tuberosum
MVTVEEYRKAQRAEGPATILAIGTSTPSNCVDQSTYPDYYFRITNSEHKTELKEKFKRMCDKSMIKKRYMHLTEEILKENPNMCAYMAPSLDARQDIVVVEVPKLGKEAAQKAIKEWGQPKSKITHLVFCTTSGVDMPGCDYQLAKLLGLRPSVKRLMMYQQGCFAGGTVLRLAKDLAENNKGARVLVVCSEITAVTFRGPSESHLDSLVGQALFGDGAAAIIMGSDPIIGVERPLFELVSAAQTLVPDSEGAIDGHLREVGLTFHLLKDVPGLISKNIEKSLLEAFQPLGISDWNSLFWIAHPGGPAILDQVELKLGLKQEKLRATREVLSNYGNMSSACVLFILDEMRKASTKEGLGTTGEGLEWGVLFGFGPGLTVETVVLHSVAT

SEQ ID NO: 2339 - protein, 389 aa, Solanum tuberosum
MVTVEEVRKAQRAKGPATIMAIGTATPSNCVDQSTYPDYYFRITNSEHMTELKEKFKRMCDKSMINKRYMHLTEEILKENPNICEYMAPSLDARQDIVVVEVPKLGKEAAQKAIKEWGQPKSKITHVVFCTTSGVDMPGADYQLTKLLGLRPSVKRLMMYQQGCFAGGTVIRLAKDLAENNKGARVLVVCSEITAVTFSGPSDTHLDSMVGQALFGDGAAAMIIGSDPLPEVERPLFELVSAAQTLLPDSEGAIDGHLREVGLTFHLLKDVPGLISKNIEKSLIEAFQPLGISDWNSIFWIAHPGGPAILDQVELKLGLKPEKLQATRQVLSDYGNMSSACVLFILDEMRKASSKEGLSTTGEGLDWGVLFGFGPGLTVETVVLHSVST

SEQ ID NO: 2340 - protein, 354 aa, Zinnia elegans
MGSNQDDQAFLFAMQLASASVLPMVLKTAIELDLLETIAKAGPHGSVSSSELVAQLPKVNNPEAPVMIDRICSLLASYSVLTCTLKETADGCAERFYGLAPVCKFLIKNDAGVSLAPLLLMNQDKVLMESWYYLKDPVLDGGIPFNKAYGMSAFEYHGKDQRFNKVFNSGMFNHSTMTMKKIVELYNGFSGLKTLVDVGGGTGASLNMITSKHKSLKGINFDLPHVIADATTYQGIEHVGGDMFESVPKGDAIFMKWILHDWSDAHCLQVLKNCYKSLPENGKVIVAECILPEAPDTTPATQNVIHIDVIMLAHNPGGKERTEKEFEALAKGAGFKGFNKAACALNTWVMEFCK

SEQ ID NO: 2341 - protein, 440 aa, Alnus glutinosa
MAEITHIKARQIFDSRGNPTVEAEVTTANGVVSRAAVPSGASTGVYEALELRDGGSDYLGKGVLKAVDNVNKIIGPALIGKDATEQTAIDIDFMFQQLDGTVNEWGWCKQKLGANAILAVSLAVCKAGASVKKIPLYKHIANLAGNPKLVLPVPAFNVINGGSHAGNKLAMQEFMILPVGASSFKEAMKMGVEVYHHLKAVIKKKYGQDATNVGDEGGFAPNIQENKEGLELLKTAIAKAGYVVIGMDVAASEFYEKDKDITNFKEENNDGSQKISADQLKDLYKSFVDEYPIVSIEDPFDQDDWEHYSKLTAEIGEKVQIVGDDLLVTNPKRVEKAIKEKACNALLLKVNQIGSVTESIEAVKMSKRAGWGVMAHRSGETEDTFIADLSVGLATGQIKTGAPCRSERLAKYNQLLRIEEELGSEAVYAGANFRTPVEPY

SEQ ID NO: 2342 - protein, 500 aa, Nicotiana tabacum
MDTLLKTPNKLEFLHPVHGFSVKASSFNSVKPHKFGSRKICENWGKGVCVKAKSSALLELVPETKKENLDFELPMYDPSKGLVVDLAVVGGGPAGLAVAQQVSEAGLSVVSIDPSPKLIWPNNYGVWVDEFEAMDLLDCLDATWSGTVVYIDDNTTKDLDRPYGRVNRKQLKSKMMQKCILNGVKFHHAKVIKVIHEEAKSMLICNDGVTIQATVVLDATGFSRCLVQYDKPYKPGYQVAYGILAEVEEHPFDTSKMVLMDWRDSHLGNNMELKERNRKVPTFLYAMPFSSNKIFLEETSLVARPGLRMDDIQERMVARLNHLGIKVKSIEEDEHCVIPMGGSLPVIPQRVVGTGGTAGLVHPSTGYMVARTLAAAPVVANAIIHYLGSEKDLLGNELSAAVWKDLWPIERRRQREFFCFGMDILLKLDLPATRRFFDAFFDLEPRYWHGFLSSRLYLPELIFFGLSLFSRASNTSRIEIMTKGTLPLVNMINNLLQDTE

SEQ ID NO: 2343 - protein, 365 aa, Prunus dulcis
MGSTGETQMTPTQVSDEEANLFAMQLASASVLPMVLKAAIELDLLEIMAKAGPGVFLSPTDIASQLPTKNPDAPVMLDRMLRLLASYSILTYSLRTLADGKVERLYGLGPVCKFLTKNEEGVSIAPLCLMNQDKVLLESWYHLKDAVLEGGIPFNKAYGMTAFEYHGTDPRFNKVFNRGMADHSTITMKKILETYKGFEGLTSVVDVGGGTGAVLNMIVSKYPSIKGINFDLPHVIEDAPQYPGVEHVGGDMFVSVPKGDAIFMKWICHDWSDEHCLKFLKNCYAALPDNGKVILGECILPVAPDSSLATKGVVHIDVIMLAHNPGGKERTEQEFQALAKGAGFQGFNVACSAFNTYVIEFLKKN

SEQ ID NO: 2344 - protein, 473 aa, Petunia hybrida
MENEMKHSNDALHVVMFPFFAFGHISPFVQLANKLSSYGVKVSFFTASGNASRVKSMLNSAPTTHIVPLTLPHVEGLPPGAESTAELTPASAELLKVALDLMQPQIKTLLSHLKPHFVLFDFAQEWLPKMANGLGIKTVYYSVVVALSTAFLTCPARVLEPKKYPSLEDMKKPPLGFPQTSVTSVRTFEARDFLYVFKSFHNGPTLYDRIQSGLRGCSAILAKTCSQMEGPYIKYVEAQFNKPVFLIGPVVPDPPSGKLEEKWATWLNKFEGGTVIYCSFGSETFLTDDQVKELALGLEQTGLPFFLVLNFPANVDVSAELNRALPEGFLERVKDKGIIHSGWVQQQNILAHSSVGCYVCHAGFSSVIEALVNDCQVVMLPQKGDQILNAKLVSGDMEAGVEINRRDEDGYFGKEDIKEAVEKVMVDVEKDPGKLIRENQKKWKEFLLNKDIQSKYIGNLVNEMTAMAKVSTT

SEQ ID NO: 2345 - protein, 341 aa, Brassica napus
MFRSALVRSSASAKQSLLRRSFSSGSVPERKVAILGAAGGIGQPLALLMKLNPLVSSLSLYDIANTPGVAADVGHINTRSQVVGYMGDDNLAKALEGADLVIIPAGVPRKPGMTRDDLFNINAGIVKNLWSAIAKYCPHALVNMISNPVNSTVPIAAEIFKKAGMYDEKKLFGVTTLDVVRVKTSYAGKANVPVAEVNVPAIVGHAGVTILPLFSQATPQAILSGDALTVTTKRTQDGGTEVEEAKAGKGSATLSMAYAGALFADACLKGLNGVPDVVECSYVQSTITELPFFASKVRLGKNGVEEVLDLGPLSDFEKEGLEALRPGIKSTIEKGVKFANQ

SEQ ID NO: 2346 - protein, 473 aa, Hordeum vulgare
MAAAAVAADSKIDGLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLIHNQNEYCMEVTPKTLADVKGGTLISYEGRVQLLEIAQVPDEHVDEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDI

SEQ ID NO: 2347 - protein, 425 aa, Arabidopsis thaliana
MQSVSKMTVKSSLIDPDGGELVELIVPETEIGVKKAESETMPKVKLNQIDLEWVHVISEGWASPLKGFMREDEYLQSLHFNSLRLKNGTFVNMSLPIVLAIDDDTKEQIGSSENVALVCPQGDIIGSLRSVEIYKHNKEERIARTWGTTSPGLPYVEEYITPSGNWLIGGDLEVFEPIKYNDGLDHYRLSPKQLREEFDNRQADAVFAFQLRNPVHNGHALLMNDTRKRLLEMGYKNPVLLLHPLGGFTKADDVPLDVRMEQHSKVLEDGVLDPKTTIVSIFPSPMHYAGPTEVQWHAKARINAGANFYIVGRDPAGMGHPTEKRDLYDPDHGKRVLSMAPGLEKLNILPFRVAAYDTIEKKMAFFDPSRAKEFLFISGTKMRTYARTGENPPDGFMCPSGWNVLVKYYESLQESEAKQQAVVSA

SEQ ID NO: 2348 - protein, 147 aa, Dugong dugon
MVYFTAEEKAAITSLWGKVNVEEAGGKALGRLLIVYPWTQRFFDKFGNLSSASAIMGNPKIKAHGKKVLNSFGDAVENPDNLKGTFAKLSELHCDKLLVDPEDFRLLGNVIVIVLANHFGKEFTPQVQAAWQKMVTGVASALARKYH

SEQ ID NO: 2349 - protein, 98 aa, Escherichia coli
MEKRTPHTRLSQVKKLVNAGQVRTTRSALLNADELGLDFDGMCNVIIGLSESDFYKSMTTYSDHTIWQDVYRPRLVTGQVYLKITVIHDVLIVSFKEK

SEQ ID NO: 2350 - protein, 191 aa, Escherichia coli
MPLLHLLRQNPVIAAVKDNASLQLAIDSECQFISVLYGNICTISNIVKKIKNAGKYAFIHVDLLEGASNKEVVIQFLKLVTEADGIISTKASMLKAARAEGFFCIHRLFIVDSISFHNIDKQVAQSNPDCIEILPGCMPKVLGWVTEKIRQPLIAGGLVCDEEDARNAINAGVVALSTTNTGVWTLAKKLL

SEQ ID NO: 2351 - protein, 178 aa, Methanosarcina barkeri
MFIKYAEVLNLVKNILKSMVGEALIGSGPEVAHIDLVIGPRGGSVEAAFMNSLAMPRQGHTPLLAVLEPNIQPKPTTLIVNKVTIKNVSQAALMFGPAQAAVAKAVMDSVADGVLPEEQADDIFIIVSVFIEWDAKDKDKVYEFNYEATKLAIARAMEGRPTVEEALAKKDSANHPFA

SEQ ID NO: 2352 - protein, 803 aa, Rattus norvegicus
MIPVTEFRQFSEQQPAFRVLKPWWDVFTDYLSVAMLMIGVFGCTLQVMQDKIICLPKRVQPAQNHSSLSNVSQTVINTTPLPPPKPSPTNPATVEMKGLKTDLDLQQYSFINQMCYERALHWYAKYFPYLVLIHTLVFMLCSNFWFKFPGSSSKIEHFISILGKCFDSPWTTRALSEVSGEDSEEKDNRKNNMNRSNTIQSGPEGSLVKSQSLKSIPEKFVVDKSTAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWLFYRSLREYSFEYVRQETGIDDIPDVKNDFAFMLHMIDQYDPLYSKRFAVFLSEVSENKLKQLNLNNEWTPDKLRQKLQTNAHNRLELPLIMLSGLPDTVFEITELQSLKLEIIKNVMIPATIAQLDNLQELSLHQCSVKIHSAALSFLKENLKVLSVKFDDMRELPPWMYGLRNLEELYLVGSLSHDISKNVTLESLRDLKSLKILSIKSNVSKIPQAVVDVSSHLQKMCIHNDGTKLVMLNNLKKMTNLTELELVHCDLERIPHAVFSLLSLQELDLKENNLKSIEEIVSFQHLRKLTVLKLWYNSIAYIPEHIKKLTSLERLFFSHNKVEVLPSHLFLCNKIRYLDLSYNDIRFIPPEIGVLQSLQYFSITCNKVESLPDELYFCKKLKTLKIGKNSLSVLSPKIGNLLFLSYLDIKGNHFEVLPPELGDCRALKRAGLVVEDALFETLPSDVREQMKAD

SEQ ID NO: 2353 - protein, 132 aa, Rattus norvegicus; identical to SEQ ID NO: 69

SEQ ID NO: 2354 - protein, 103 aa, Rattus norvegicus; identical to SEQ ID NO: 70

SEQ ID NO: 2355 - protein, 321 aa, Xenopus tropicalis
MGHVLSFTHCKDAPSTASSTPDSCPPEGEEDDSPVTEVNFWPLPSPHEPTFSYITIGSTAPLSRPPVRARRGLGQSRVHAAPREETEEKEVKDVVTYVLLEKTCQLKKLSPPHVQEEVVFVAKPQPQLEVFRAVKDLLYWRDILLSAGCLTGVTLSLLCLSQFSVISVFAYGCLIILSVTLTLRLYTKLLHALKRGNGANPFQYYLDADLKLTTKQAEEITARVLSLLSTTICTLRSLFLVEELKDSLKFLVIIYLLTYVGAVFNGITVLLLCVIGAFTFPILYKQHQTQVDHYVSLVSKKGNAFRSKIQGTVKKPPAKQK

SEQ ID NO: 2356 - protein, 192 aa, Xenopus tropicalis
MNKAVKDLLYWRDILLSAGCLTGVTLSLLCLSQFSVISVFAYGCLIILSVTLTLRLYTKLLHALKRGNGANPFQYYLDADLKLTTKQAEEITARVLSLLSTTICTLRSLFLVEELKDSLKFLVIIYLLTYVGAVFNGITVLLLCVIGAFTFPILYKQHQTQVDHYVSLVSKKGNAFRSKIQGTVKKPPAKQK

SEQ ID NO: 2357 - protein, 300 aa, Macaca fascicularis
MKILLDLLLLLPLLIVCCLESFVKLFIPKRRKSVAGEIVLITGAGHGIGRLTAYEFAKLKSKLVLWDINKHGLEETAAKCKGLGAKVYTFVVDCSNREDIYSSAKKVKAEIGDVSILVNNAGVVYTSDLFATQDAQIEKTFEVNILAHFWTTKAFLPAMMKNNHGHVVTVASAAGHISVPFLLAYCSSKFSAVGFHKALTDELAALQITGVKTTCLCPNFVNTGFIKNPSTSLGPALEPEEVVNRLMNGILTEQKMIFSPSSIAFLTILERILPERFLAVLKRKINIKFDAVIGYKMKAQ

SEQ ID NO: 2358 - protein, 180 aa, Macaca fascicularis
MKILLDLLLLLPLLIVCCLESFVKLFIPKRRKSVAGEIVLITGAGHGIGRLTAYEFAKLKSKLVLWDINKHGLEETAAKCKGLGAKVYTFVVDCSNREDIYSSAKKVKAEIGDVSILVNNAGVVYTSDLFATQDAQIEKTFEVNILAHFWTTKAFLPAMMKNNHGHVVTVASAAGHISVP

SEQ ID NO: 2359 - protein, 186 aa, Macaca fascicularis
MKILLDLLLLLPLLIVCCLESFVKLFIPKRRKSVAGEIVLITGAGHGIGRLTAYEFAKLKSKLVLWDINKHGLEETAAKCKGLGAKVYTFVVDCSNREDIYSSAKKVKAEIGDVSILVNNAGVVYTSDLFATQDAQIEKTFEVNILAHFWTTKAFLPAMMKNNHGHVVTVASAAGHISVPFLLAYC

SEQ ID NO: 2360 - protein, 172 aa, Methylomicrobium alcaliphilum
MLPDKTALPIITLSQPTAEVGAQVHRLISKCPPLDPNSMYCNLLQSSHFSETAVAAKIGDELVGFVSGYRIPQRPDTLFVWQVAVGEKARGQGLATRMLKAILARPVNQDINRIETTITPNNKASWALFEGLAKKLDTQIGSAVMFDKTRHFADQHETEMLVKVGPFKAVQA

SEQ ID NO: 2361 - protein, 469 aa, Pseudomonas fluorescens
MSAVNTPAGFTDYKVADISLAAWGRRETIIAESEMPALMGLRRKYLAEQPLKGAKILGCIHMTIQTAVLIETLVALGAEVRWSSCNIFSTQDQAAASIAAAGIPVFAWKGETEEEYEWCLEQTILKDGKPWDANMILDDGGDLTQLLHDKYPQVLDRVHGVTEETTTGVHRLLDMLAKGELKVPAINVNDSVTKSKNDNKYGCRHSLNDAIKRGTDHLLSGKQALVIGYGDVGKGSAQSLRQEGMIVKVSEVDPICAMQACMDGFELVSPFIDGINHGTEASIDKALLGKIDLIVTTTGNVNVCDANMLKALKKRAVVCNIGHFDNEIDTAFMRKNWAWEEVKPQVHKIHRTGPGDFDAQNDDYLILLAEGRLVNLGNATGHPSRIMDGSFANQVLAQIFLFGQKYADLSPAQKAERLTVEVLPKKLDEEVALEMVRGFGGVVTQLTKQQAEYIGVTVEGPFKPDAYRY

SEQ ID NO: 2362 - protein, 352 aa, Pseudomonas fluorescens
MSKQPSLSYKDAGVDIDAGEALVERIKSVAKRTARPEVMGGLGGFGALCEIPAGYKQPVLVSGTDGVGTKLRLALNLNKHDSIGIDLVAMCVNDLVVCGAEPLFFLDYYATGKLNVDTAAQVVTGIGAGCELSGCSLVGGETAEMPGMYEGEDYDLAGFCVGVVEKAEIIDGSKVAAGDALLALPSSGPHSNGYSLIRKIIEVSGADIESIQLDGKPLTDLLMAPTRIYVKPLLKLIKDTGAVKAMAHITGGGLLDNIPRVLPKGAQAVVDVASWQRPAVFDWLQEKGNVDEHEMHRVLNCGVGMVICVAQDQVENALKVLREAGEQPWVIGQIATAAEGAAQVELKNLKAH

SEQ ID NO: 2363 - protein, 87 aa, Rattus norvegicus
VLEMLPGSQHVSTAVVKTISLKEKFPGENIVSQSFSSHSDLIPGVYEGGLKIWECTFDLMTYFTKAKVKFAGQKVLDLGCGSGLLGI

SEQ ID NO: 2364 - protein, 133 aa, Rattus norvegicus
IPKDCDQVLENKVLEMLPGSQHVSTAVVKTISLKEKFPGENIVSQSFSSHSDLIPGVYEGGLKIWECTFDLMTYFTKAKVKFAGQKVLDLGCGSGLLGITASKGGAREVHFQDYNGLVIDEVTLPNVVANVPL

SEQ ID NO: 2365 - protein, 61 aa, Tscherskia triton
QVEQDGRSGHGLRRSSKFCLKEHKALKTLGIIMGTFTLCWLPFFIVNIVHVIQENLIPKEV

SEQ ID NO: 2366 - protein, 31 aa, Tscherskia triton; identical to SEQ ID NO: 645

SEQ ID NO: 2367 - protein, 401 aa, Bos taurus; identical to SEQ ID NO: 1534

SEQ ID NO: 2368 - protein, 447 aa, Mus musculus
MGRTYIVEETVGQYLSSINLQGKPFVSGLLIGQCSSQKDYVILATRTPPKEEQNDKVKQPRAKLDNLDEEWATEHASQVSRMLPGGLVVLGIFIITTLELADDFQNALRRLIFSMEKSMSRKRLWDVTEDEVSERVTLHICSSTKKISCRTYDVQDPKSSARPADWKYQSRVSASWLSLDCTVHVNIHIPLSATSVSYTLEKNTKSGLTRWAKQIENGVYLINGQVKGNDCDLLEGQKKSRGNTQATAHSFDVRVLTQLLLNSDHRSTATVQICSGSVNLRGNVKCRAYIHSNRPKVKDAVQAVKRDILNTVADRCEILFEDLLLNEIPEKKNYELPQRVFVPLPGSTVMLCDYKFGDESAEEIRDHFSEMLDHEIQIEDLEIAEEVNTACMTSSVNSEASLTNTSEEQPEQPKKTIGVKIQQNIGVIAALAVAVLAAGISFHYFSD

SEQ ID NO: 2369 - protein, 189 aa, Mus musculus
MAGKQPPPLMKKHSQTDLVSRLKTRKILGVGGEDDDGEVHRSKISQVLGNEIKFAVREPLGLRVWQFLSAMLFSSVAIMALALPDQLYDAVFDGAEVTSKTPIRLYGGALLSISLIMWNALYTAEKVIIRWTLLTEACYFGVQSLVVTATLAETGLMSLGTVLLLASRLLFVIVSIYYYYQVGRKPKKV

SEQ ID NO: 2370 - protein, 622 aa, Macaca fascicularis
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWVSVKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 2371 - protein, 1534 aa, Macaca fascicularis
MAAEPSKTGPSRSAYQRMGRKSQHWGAADIQCTRCGRRVSRASGHHCELQCGHAFCELCLLMTEECTTIVCPDCEVATAVNTRQGCYAMAGYVKEDSVMEKRQPKTIKNCSQDFKKTADQLTTGLERSASTHRTVLNSSSVMLDTNTAEEIDEALTTAHHNFEQLSIAGKALEHMQKQTIEERERVTEVVEKQFDQLLAFFDSRKKKYNNKKGLSCYDTYPPLEKKKVDMSVVTNEAPPPPLQPETNDVHLEAKIFQPQKDVVATASSKTIAVLPQMGSSPDVIIEEIIEDNMETCSTDDLGETPRYPKKPLQKNSSVPFGSKAGSAELVFVSHVIDPCHFYIRKYSQIKDAKVLEKKVNEFCNRSSHLDPSDILELGARIFVNSIKNGMWCRGTITELIPIEGKNTRKPCSPTRLFVHEVALIQIFMVDFGNSEVLIVTGVVDTHVRPEHSAKQHIALNDLCLILRKSEPYIEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDFLFLLKTIEEFYKNEAGENLEILCPVQDQVCVAKFEDGIWYRAKVIGLPGHQEVEVKYVDFGNTAKITIKDVRKIKDEFLTAPEKAIKCKLAYIEPYKRTMQWSKEAKEKFEDKAQDKFMTCSIIKILEDNVLLVELFDSLGVPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLQENLKTMGRLSLECSLVDIRPAGGSDKWTATACDCLSLYLTGAVATIILQVDSEENNTTWPLPVKIFCRDEKGERVDVSKYLIKKGLALRERRINKLDNSHSLSEKSLEVPLEQEDSVVTNCIKTNFDPDKKTADIISEQKVSEFQEEILEPRTARGYKPPAIPNMKVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKREVDIHIMELPKNPWEKLSIHLYFDGMSLSYFMAYYKYCTSEHTEEMLKEKPRSDHDRKYEEEQWEIRFEELLSSETDTPLLPPYLSSSLPSPGELCAVQVKHVVSPNEVYICLDSIETCNHSNQHSDTDDSGVSGESESESLDEALQRVNKKVEALPPLTDFRTEMPCLAEYDDGLWYRAKIVSIKEFNPLSILVQFVDYGSTAKLTLNRLCQIPPHLMRYPARAIKVLLAGFKPPLRDLGETRIPYCPKWSMEALWAMIDCLQGKQLYAVSMAPAPEQIVTLYDEEQHPVHMPLVEMGLADKDE

SEQ ID NO: 2372 - protein, 1446 aa, Macaca fascicularis
MAGYVKEDSVMEKRQPKTIKNCSQDFKKTADQLTTGLERSASTHRTVLNSSSVMLDTNTAEEIDEALTTAHHNFEQLSIAGKALEHMQKQTIEERERVTEVVEKQFDQLLAFFDSRKKKYNNKKGLSCYDTYPPLEKKKVDMSVVTNEAPPPPLQPETNDVHLEAKIFQPQKDVVATASSKTIAVLPQMGSSPDVIIEEIIEDNMETCSTDDLGETPRYPKKPLQKNSSVPFGSKAGSAELVFVSHVIDPCHFYIRKYSQIKDAKVLEKKVNEFCNRSSHLDPSDILELGARIFVNSIKNGMWCRGTITELIPIEGKNTRKPCSPTRLFVHEVALIQIFMVDFGNSEVLIVTGVVDTHVRPEHSAKQHIALNDLCLILRKSEPYIEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDFLFLLKTIEEFYKNEAGENLEILCPVQDQVCVAKFEDGIWYRAKVIGLPGHQEVEVKYVDFGNTAKITIKDVRKIKDEFLTAPEKAIKCKLAYIEPYKRTMQWSKEAKEKFEDKAQDKFMTCSIIKILEDNVLLVELFDSLGVPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLQENLKTMGRLSLECSLVDIRPAGGSDKWTATACDCLSLYLTGAVATIILQVDSEENNTTWPLPVKIFCRDEKGERVDVSKYLIKKGLALRERRINKLDNSHSLSEKSLEVPLEQEDSVVTNCIKTNFDPDKKTADIISEQKVSEFQEEILEPRTARGYKPPAIPNMKVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKREVDIHIMELPKNPWEKLSIHLYFDGMSLSYFMAYYKYCTSEHTEEMLKEKPRSDHDRKYEEEQWEIRFEELLSSETDTPLLPPYLSSSLPSPGELCAVQVKHVVSPNEVYICLDSIETCNHSNQHSDTDDSGVSGESESESLDEALQRVNKKVEALPPLTDFRTEMPCLAEYDDGLWYRAKIVSIKEFNPLSILVQFVDYGSTAKLTLNRLCQIPPHLMRYPARAIKVLLAGFKPPLRDLGETRIPYCPKWSMEALWAMIDCLQGKQLYAVSMAPAPEQIVTLYDEEQHPVHMPLVEMGLADKDE

SEQ ID NO: 2373 - protein, 947 aa, Macaca fascicularis
MTDVSVTVCHINSPGDFYLQLIEGLDFLFLLKTIEEFYKNEAGENLEILCPVQDQVCVAKFEDGIWYRAKVIGLPGHQEVEVKYVDFGNTAKITIKDVRKIKDEFLTAPEKAIKCKLAYIEPYKRTMQWSKEAKEKFEDKAQDKFMTCSIIKILEDNVLLVELFDSLGVPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLQENLKTMGRLSLECSLVDIRPAGGSDKWTATACDCLSLYLTGAVATIILQVDSEENNTTWPLPVKIFCRDEKGERVDVSKYLIKKGLALRERRINKLDNSHSLSEKSLEVPLEQEDSVVTNCIKTNFDPDKKTADIISEQKVSEFQEEILEPRTARGYKPPAIPNMKVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKREVDIHIMELPKNPWEKLSIHLYFDGMSLSYFMAYYKYCTSEHTEEMLKEKPRSDHDRKYEEEQWEIRFEELLSSETDTPLLPPYLSSSLPSPGELCAVQVKHVVSPNEVYICLDSIETCNHSNQHSDTDDSGVSGESESESLDEALQRVNKKVEALPPLTDFRTEMPCLAEYDDGLWYRAKIVSIKEFNPLSILVQFVDYGSTAKLTLNRLCQIPPHLMRYPARAIKVLLAGFKPPLRDLGETRIPYCPKWSMEALWAMIDCLQGKQLYAVSMAPAPEQIVTLYDEEQHPVHMPLVEMGLADKDE

SEQ ID NO: 2374 - protein, 1509 aa, Macaca fascicularis
MAAEPSKTGPSRSAYQRMGRKSQHWGAADIQCTRCGRRVSRASGHHCELQCGHAFCELCLLMTEECTTIVCPDCEVATAVNTRQGCYAMAGYVKEDSVMEKRQPKTIKNCSQDFKKTADQLTTGLERSASTHRTVLNSSSVMLDTNTAEEIDEALTTAHHNFEQLSIAGKALEHMQKQTIEERERVTEVVEKQFDQLLAFFDSRKKKYNNKKGLSCYDTYPPLEKKKVDMSVVTNEAPPPPLQPETNDVHLEAKIFQPQKDVVATASSKTIAVLPQMGSSPDVIIEEIIEDNMETCSTDDLGETPRYPKKPLQKNSSVPFGSKAGSAELVFVSHVIDPCHFYIRKYSQIKDAKVLEKKVNEFCNRSSHLDPSDILELGARIFVNSIKNGMWCRGTITELIPIEGKNTRKPCSPTRLFVHEVALIQIFMVDFGNSEVLIVTGVVDTHVRPEHSAKQHIALNDLCLILRKSEPYIEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDFLFLLKTIEEFYKNEAGENLEILCPVQDQVCVAKFEDGIWYRAKVIGLPGHQEVEVKYVDFGNTAKITIKDVRKIKDEFLTAPEKAIKCKLAYIEPYKRTMQWSKEAKEKFEDKAQDKFMTCSIIKILEDNVLLVELFDSLGVPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLQENLKTMGRLSLECSLVDIRPAGGSDKWTATACDCLSLYLTGAVATIILQVDSEENNTTWPLPVKIFCRDEKGERVDVSKYLIKKGLALRERRINKLDNSHSLSEKSLEVPLEQEDSVVTNCIKTNFDPDKKTADIISEQKVSEFQEEILEPRTARGYKPPAIPNMKVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKREVDIHIMELPKNPWEKLSIHLYFDGMSLSYFMAYYKYCTSEHTEELLSSETDTPLLPPYLSSSLPSPGELCAVQVKHVVSPNEVYICLDSIETCNHSNQHSDTDDSGVSGESESESLDEALQRVNKKVEALPPLTDFRTEMPCLAEYDDGLWYRAKIVSIKEFNPLSILVQFVDYGSTAKLTLNRLCQIPPHLMRYPARAIKVLLAGFKPPLRDLGETRIPYCPKWSMEALWAMIDCLQGKQLYAVSMAPAPEQIVTLYDEEQHPVHMPLVEMGLADKDE

SEQ ID NO: 2375 - protein, 417 aa, Macaca fascicularis
MSLSKKLTLDKLDVRGKRVIMRVDFNVPMKKNQITNNQRIKASIPSIKYCLDNGAKAVVLMSHLGRPDGVPMPDKYSLQPVAAELKSLLGKDVLFLKDCVGAEVENACANPAPGSVILLENLRFHVEEEGKGQDPSGKKIKAEPDKIEGFRASLSKLGDVYVNDAFGTAHRAHSSMVGVNLPHKASGFLMKKELDYFAKALENPVRPFLAILGGAKVADKIQLIKNMLDKVNEMIIGGGMAYTFLKVLNNMEIGASLFDEEGAKIVKDIMTKAQKNGVRITFPVDFVTADKFDENAQVGKATVASGIPPGWMGLDCGPESNKNHAQVVAQARLIVWNGPLGVFEWDAFAKGTKALMDEIVKATSKGCITIIGGGDTATCCAKWNTEDKVSHVSTGGGASLELLEGKILPGVEALSNM

SEQ ID NO: 2376 - protein, 305 aa, Macaca fascicularis
MDDKELIEYFKSQMKEDPDMASAVAAIRTLLEFLKRDKGETIQGLRANLTSAIETLCGVDSSVAVSSGGELFLRFISLTSLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKIGTNQMAVCAKAQNKPFYAVAESFKFVRLFPLNQQDVPDKFKYKADTLKVAQTGQDLKEEHPWVDYTAPSLITLLFTDLGVLTPSAVSDELIKLYL

SEQ ID NO: 2377 - protein, 463 aa, Macaca fascicularis
MAASVFYGRLLAVATLRNHRPRTALGAAAQVLGSSGLFNNHGLQVQQQQQRNLSLHEYMSMELLQEAGVSIPKGCVAKSPDEAYAVAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSQGGVNIEDVAAETPEAIITEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAQANLNYIGLDGNIGCLVNGAGLAMATMDIIKLHGGTPANFLDVGGGATVHQVTEAFKLITSDKKVLAILVNIFGGIMSCDVIAQGIVTALKDLEIKIPVVVRLQGTRVDDAKALIAGSGLKILACDDLDEAARMVVKLSEIVTLAKQAHVDVKFQLPI

SEQ ID NO: 2378 - protein, 338 aa, Macaca fascicularis
MLSALARPASAALRRSFSTSAQNNAKVAVLGASGGIGQPLSLLLKNSPLVSRLTLYDIAHTPGVAADLSHIETKAVVKGYLGPEQLPDCLKGCDVVVIPAGVPRKPGMTRDDLFNTNATIVATLAAACAQHRPEAMICIIANPVNSTIPITAEVFKKHGVYNPSKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGQIPSFEEKMISDAIPELKASIKKGEDFVKTLK

SEQ ID NO: 2379 - protein, 334 aa, Macaca fascicularis
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 2380 - protein, 312 aa, Macaca fascicularis
MESALPAAGFLYWVGAGTVAYLALRISYSLFTALRVWGVGNEAGVGPGLGEWAVVTGGTDGIGKSYAEELAKRGMKVVLISRSQDKLDQVSSEIKEKFKVETRTIAVDFTLEDIYDKIKTGLAGLEIGILVNNVGMSYEYPEYFLDVPDLDNVIKKMININILSVCKMTQLVLPGMVERSKGAILNISSGSGMFPVPLLTIYSATKTFVDFFSQCLHEEYRSKGIFVQSVLPYFVATKLAKIRKPTLDKPTPETFVKSAIKTVGLQSRTNGYLIHVLMGWIISNLPSWIYLKIAMNMNKATRVHYLKKIKKN

SEQ ID NO: 2381 - protein, 548 aa, Macaca fascicularis
MALHVPKAPGFAQMLKEGAKHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDVDEVSSLLRTSIMSKQYGNEVFLAKLIAQACVSIFPDSGHFNVDNIRVCKILGSGISSSSVLHGMVFKKETEGDVTSVKDAKIAVYSCPFDGTITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVCLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 2382 - protein, 112 aa, Macaca fascicularis
ADRYMAIVQPKYAKELKNTCKAVLACVGVWIMTLTTTIPLLLLHKDPDKDSTPATCLKISDIVYLKAVNVLNFTRLTFFFLIPLFIMIGCYLVIIHNLLHGRTSKLKPKVKE

SEQ ID NO: 2383 - protein, 108 aa, Macaca fascicularis
CKAVLACVGVWIMTLTTTIPLLLLHKDPDKDSTPATCLKISDIVYLKAVNVLNFTRLTFFFLIPLFIMIGCYLVIIHNLLHGRTSKLKPKVKEKSIRIIITLLVQVLV

SEQ ID NO: 2384 - protein, 357 aa, Macaca fascicularis
MAAAAKPKNLSLVVHGPGDLRLENYPIPEPGPNEVLLRMHSVGICGSDVHYWEEGRIGNFIVKKPMVLGHEASGTVEKVGSLVKHLKPGDRVAIEPGVPRENDEFCKSGRYNLSPSIFFCATPPDDGNLCRFYKHNAAFCYKLPDNVTFEEGALIEPLSVGIHACRRGGVTLGHRVLVCGAGPIGVVSLLVAKAMGAAQVVVTDLSAPRLSKAKEIGADLVLQISKESPQEIAGKVEGLLGCKPEVTIECTGAEASIQAGIYATRSGGTLVLVGLGSEMTTIPLLHAAVREVDIKGVFRYCNTWPVAISMLASKSVNIKPLVTHRFPLEKALEAFETFKKGLGLKIMLKCDPNDQNP

SEQ ID NO: 2385 - protein, 77 aa, Macaca fascicularis
VLVGLGSEMTTIPLLHAAVREVDIKGVFRYCNTWPVAISMLASKSVNIKPLVTHRFPLEKALEAFETFKKGLGLKIM

SEQ ID NO: 2386 - protein, 85 aa, Macaca fascicularis
VLVGLGSEMTTIPLLHAAVREVDIKGVFRYCNTWPVAISMLASKSVNIKPLVTHRFPLEKALEAFETFKKGLGLKIMLKCDPNDQ

SEQ ID NO: 2387 - protein, 993 aa, Macaca fascicularis
SLWGTPRLPCSPGWQGATKRLLVRSVSGASNHQPNSNTGRYRDTVLLPQTSFPMKLLGRQQPDKELEIQQKCGFSELYSWQRERKVKTEFCLHDGPPYANGDPHVGHALNKILKDIANRFHMMSGSKVHFVPGWDCHGLPIEIKVLSELGREAQNLSAMEIREKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSFLVWTTQPWTIPANEAVCYMPESKYAVVKCSKSGDLYVLAADKVETVASTLETAFETISTFSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINIADIKIAAKELLKKVKFIPGSALNGMVEMMDRRPYWCISRQRVWGVPIPVFHHKTKDEYLINSQTIEHIVKLVEQHGSDVWWTLPPEQLLPKEVLSEVGGPDALEYVPGQDILDIWFDSGTSWSHVLPGPDQRADLYLEGKDQLGGWFQSSLLTSVATRKKAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSHFYFSIIKDRLYCEKENDPRRRSCQTALVEILDVIVRSFAPILPHLAEEVFQHIPYIKEPKSVFRTGWISTSSIWKKPGLEEAVESVCAMRDSFLGSIPGKNAAEYKVIIVIEPGLLFEIIEMLQSEETSSTSQLNELMMASESTLLAQEPRELTADVIELKGKFLINLEGGDIREESSYKVIVMPTTKEKCPRCWKYTAESSDTLCPRCAEVVSGK

SEQ ID NO: 2388 - protein, 110 aa, Macaca fascicularis
IYKKTIEVGTFLDLPRFPDITEDCYLHPNILCMKYLMEVNLPDEMHNLTCHVVKMTGMGEVDFLTFDPIAKMAKTVKYDVQAVAIIVVVLKLLFLLDDNLEWSLSNLAEK

SEQ ID NO: 2389 - protein, 114 aa, Macaca fascicularis
IYKKTIEVGTFLDLPRFPDITEDCYLHPNILCMKYLMEVNLPDEMHNLTCHVVKMTGMGEVDFLTFDPIAKMAKTVKYDVQAVAIIVVVLKLLFLLDDNLEWSLSNLAEKHNEK

SEQ ID NO: 2390 - protein, 152 aa, Macaca fascicularis
QLIFCTLAALAEERKPLECLDAFGATGIMGLQWAKHLGNAVKVTINDLNENSVTLIQENCYLNKLKVVVDSKEKEKSDDILEEGEKNIGNIKVTKMDANVLMHLRSFDFIHLDPFGTSVNYLDSAFRNIRNLGIVSVTSTDISSLYAKAQHV

SEQ ID NO: 2391 - protein, 124 aa, Macaca fascicularis
LECLDAFGATGIMGLQWAKHLGNAVKVTINDLNENSVTLIQENCYLNKLKVVVDSKEKEKSDDILEEGEKNIGNIKVTKMDANVLMHLRSFDFIHLDPFGTSVNYLDSAFRNIRNLGIVSVTST

SEQ ID NO: 2392 - protein, 633 aa, Macaca fascicularis
MKAIKKSLTEEEYLYLDFSHQTKGCIFPLHTSVTLFLLSYCDCKIFKICLVVTKEVSTDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEELDSSSESLELKVAFSKLTVQEEPATTNREPSHIRKAKASDLPPLEHVFAEGLYFTLADIVLLPCIHHFLVIICKKFSEKLVEFPLLASWYQRIQEVPRVKTAASKCGIQFLHLPKLLTVSTEQRPNLSEVPGVEGHSDPLFIGGPRPTMAKLMEKGIEVMFSPHPCPTWTVDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKSEQFKKTLSYKEHMILCRFADQTAVQLPPQRRLIGKQCMCLVDLDRARAAEECGYSVQVISMEPESCSPKNNMIVGVPI

SEQ ID NO: 2393 - protein, 727 aa, Macaca fascicularis
MAFQKAVKGTILVGGGALATVLGLSQFAHYRRKQMNLAYVKAADYISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIVLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTPHPIPSEEDINFILNEVRNYLSCDVEVRRGDVLAAWSGIRPLVTDPKSADTQSISRNHVVDISESGLITIAGGKWTTYRSMAEDTINAAIKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDHKKQEQLETAKKFLYYEMGYKSRSEQLTDRSEISLLPSDIDRYKKRFHKFDADKKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 2394 - protein, 32 aa, Macaca fascicularis
FTTLGGVYHLDILELPPQCKPVKGWMIVEILK

SEQ ID NO: 2395 - protein, 121 aa, Macaca fascicularis
SLDTFGPVTLIQDAHINMPYQSWELRPLDVNKVLLTVTTVFTEIQIQIKENLCMLSSVKLKDKKHISILEGTWMTPIPFIIALKEAGLNIFPTRYSHFYVVINNKVPLVEVKAYRQMALLS

SEQ ID NO: 2396 - protein, 398 aa, Macaca fascicularis
MALLRRPTVSSDLENIDTGFNSKVKSHVTIRRTVLEEIGNKVTTRAAQVAKKAQNTKVPVQPTKTTNVNKQLKPTASVKPVQMEMLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVAIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKLLGQGKWNLKQQYYTGYTENEVLEVMQHMAKNVVKVDENLTKFIAIKNKYASSKLLKISTIPQLNSKAVKDLASPLMGRS

SEQ ID NO: 2397 - protein, 462 aa, Macaca fascicularis
MSSVKRSPKQEIVTQFHCSAAEGDIAKLTGILSHSPSLLNETSENGWTALMYAARNGHPEIVQFLLEKGCDRSIVNKSRQTALDIAVFWGYKHIANLLATAKGGKKPWFLTNEVEECENYFSKTLLDRKSEKRNNADWLLAKESHPATVFILFSDLNPLVTLGGNKESFQQPEVRLCQLNYKDIKDYLAQPEEITLIFLGVELEMKDKLLNYAGEVPREEEDGLVAWFALGIDPIAAEEFKQRHENCYFLHPPMPALLQLKEKEAGVVAQARSVLAWHSRYKFCPTCGNGTKIEEGGYKRVCLKEDCPSLNGVHNTSYPRVDPVVIMQVIHPDGTRCLLGRQKRFPPGMFTCLAGFIEPGETIEDAVRREVEEESGVKVGHVQYVSCQPWPMPSSLMIGCLAVAVSTEIKVDKNEIEDARWFTREQVLDVLTKGKQQAFFVPPSRAIAHQLIKHWIRINPNL

SEQ ID NO: 2398 - protein, 70 aa, Macaca fascicularis
LKNDLINIDLFKDYKLIFQDKSRSLAVHSVKALLNMDDDILMVNTGSWYTVAHMSILTNNNTSKVFVCGV

SEQ ID NO: 2399 - protein, 150 aa, Macaca fascicularis
VKALLNMDDDILMVNTGSWYTVAHMSILTNNNTSKVFVCGVQSQAKDPDLKTLFTKMGCKNIEILRETFINIESKDHRLQKVKVILPLPRCSGLGVSNPVEFILNEHEDTEFLKDHSQGGISVDKLHILAQQQYEQLTHAMKFTKAQAVV

SEQ ID NO: 2400 - protein, 511 aa, Macaca fascicularis
MHTTESKDEHLEDENFQTSTTPQSLIDPNSTAHEETKTVISDTEEIKPQTKKKTYISCPLRGALNRIITNGVILFVIWCTTWSVLGSEALPGGNLFGLLIIFCSAIIGGKILQLIRIPLVPPLPPLLGMLLAGFTIRNVPFISKHVHVHNTWSSILRSTALTVILIRAGLGLDPQALRHLKVVCFRLAVGPCLMEASAAAVFSHFIMKFPWEWAFLLGFVLGAVSPAIVVPSMMVLQENGYGVEEGIPSLLMAASSMDDVLAITGFNTCLSIVFSSGGIVNNAIASIKSVSISLLAGIVLGFFVRYFPSEDQKKLALERGFLILTMCVSAVLGSQRIGLHGTGGLFTLVLSFIAGTKWSQEKMKVQKIITNVWDIFQPLLFGLVGAEVSVSLLESNTIGIFVATLSLALCVRILVTYILMCFAGFSFKEKIFIALAWMPKATVQAVLGPLVLETARVSAPHLEPYSKDVMTVAFLAILITAPNGALLMGILGPKLLRRHYDPSKIKLQLST

SEQ ID NO: 2401 - protein, 481 aa, Arabidopsis thaliana
MKNLKMVFFKILFISLMAGLAMKGSKINVEDLQKFSLHHTQNNLQTISLLLFLVVFVWILYMLTRPKPVYLVDFSCYLPPSHLKVSIQTLMGHARRAREAGMCWKNKESDHLVDFQEKILERSGLGQETYIPEGLQCFPLQQGMGASRKETEEVIFGALDNLFRNTGVKPDDIGILVVNSSTFNPTPSLASMIVNKYKLRDNIKSLNLGGMGCSAGVIAVDVAKGLLQVHRNTYAIVVSTENITQNLYLGKNKSMLVTNCLFRVGGAAVLLSNRSRDRNRAKYELVHTVRIHTGSDDRSFECATQEEDEDGIIGVTLTKNLPMVAARTLKINIATLGPLVLPLKEKLAFFITFVKKKYFKPELRNYTPDFKLAFEHFCIHAGGRALIDELEKNLKLSPLHVEASRMTLHRFGNTSSSSIWYELAYTEAKGRMKEGDRIWQIALGSGFKCNSSVWVALRDVKPSANSPWEDCMDRYPVEIDI

SEQ ID NO: 2402 - protein, 347 aa, Xenopus laevis
MAGEGALQFYRDLPKVELHAHLNGSISTATMKKLMARKPHLDIQHGMTMIDKGQKRTLEECFQMFKIIHQITDTAEDILLVTKDVIKEFAADGVKYLELRSTPRDTPAGLTKQAYVETVLEGIKQCKEEGVDIDVRFLLAIDRRGGPTAAKETVKLAEDFFCSSNELVLGLDLSGDPTVGHGRDFMEPLNKARQSGLKLALHLSEIPSQTEETELLLGLPPDRIGHGTFLTTSAHIVEIVKKQHIPLELCITSNIKGQTVSSYNEHHFGFWYNLHHPFVLCTDDKGVFATDLSVEYEIAAKTFNLTPHHVWDLSYQAIDYTFASADVKANLKEKWLLLKPDVFRHAL

SEQ ID NO: 2403 - protein, 991 aa, Xenopus laevis
MSAEAADREAATSSRPCTPPQTSWFEFLLDDSLLEKHLQKPHSDPPPVQLIVQFLEQASKPTLNEQNQVQPPTDNKRNRTLKLLALKVAAHLKWNLDVLEKSLSVPVLNMLLNELLCASKVPPGTKHVDLDLSTLPPTTVMAVTLYNRWAIRTIVQSGFPVKPVKQGPQQPNVMNQIQQEKELTENILKVLKEQAEDSITVLEGALQLKRDFYVHTMRTLDLLAVEPGMVNGETENSTAGFKISSDEMQCQGCYDLGAVYFLQGPTNPSCYEKARDHFFRTKQLVSKIGAASDHYAIDEKRLAGYCQACGVLAPSNVVSQPATPYSQIHNFMKTNNYQGILKIFLEDHLNNSLPDQFRQSVLRELFQKSQQGNGALAELCFKVCACNTVYDILHGQPVTVQFHQLFMKPSKEKIDFLLEVCSRSLMSDQASEASKRKIATFLKNLCLEIEDLQLVFMISSHELFMKMLTDEESKMVVEHLRKKTSRVSMCTKPITSFYDIPASASVNIGQLEHQLILTVDPWRIRQILIELHGMTSDRQYWKVSSKWEVPTIYSGSILGIKDNLTRDLVYILLAKGLHCSAIKDYPRAKQLLSACLELVTEFSPKLRQVMLNEMLLLDIYTYEAVSAQERPPPELISRVRGYLEMRIPDIPLRQVVAEECVAFLLNWRENECLTLQVPASLVQSNPYVKLGQLLAATCKELPGPDSRRTAKDLWEVVVQICSVSNQHKRNNDGRVCLIKNRDSTMGIMYRNELVSFIKKLREPLVLTTLLSLFVKLHNLREDIVNDITAEHISIWPSCIPNLQAVDFDAVAVTVKELVSYALTINSNSHSWLTIQADIYFATNEYSAALNYYLQAGAVCSDFFTKQVPPEVYTDQVIKRMIKCCSMLNCHTQVAILCQFLREIDYKTAFKALQEQNSHDGMDSYYDYIWDVTILEYLTYLHHKRGETDKRQIAIKAIGQTELNASNPDEVLQLAAQRRKKKFLQSMAKLYF

SEQ ID NO: 2404 - protein, 457 aa, Rattus norvegicus
MEGTDLVVKLLSTWLTLVGSLILLPSAFGLSLGISEIYMKILVKTLEWATLRIEKGAPKESVLKSPASMGIIQRDESPMEKGLSGLRGRDFELSDVFYFSKKGLEAIVEDEVTQRFSSEELVSWNLLTRTNVNFHYISPKLTIVWVLGVLVRYCFLLPLRVTLAFIGISLLIIGTTLVGQLPDSSLKNWLSELVHLTCCRICVRSLSGTIHYHNKQYRPQKGGICVANHTSPIDVLILATDGCYAMVGQVHGGLMGIIQRAMVKACPHVWFERSEIKDRHLVTKRLKEHIADKKKLPILIFPEGTCINNTSVMMFKKGSFEIGGTIYPVAIKYNPQFGDAFWNSSKYNLVSYLLRIMTSWAIVCDVWYMPPMTREEGEDAVQFANRVKSAIAVQGGLTELPWDGGLKRAKVKDTFKEEQQKTYSKMIVGNGSPSLALDSSTVDNHGSPEPAFRSESL

SEQ ID NO: 2405 - protein, 54 aa, Danio rerio
AAYSGVKKGSGSSILSALHDLPTVPWLTRSKMVKHLQVISVLQFIMTFLTMGIA

SEQ ID NO: 2406 - protein, 46 aa, Danio rerio
YSGVKKGSGSSILSALHDLPTVPWLTRSKMVKHLQVISVLQFIMTF

SEQ ID NO: 2407 - protein, 348 aa, Danio rerio
MDTEADLFYRQLPKVELHAHLNGSVSFETMEKLIKRKPHLNIEHSMTAIRRGQRRTLDECFQVFKVIHQLVDSEEDILMVAKSVIQEFAADGVKYLELRSTPREVTETGLSKQRYIETVLEAIRQCKQEGVDIDVRFLVAVDRRHGPEVAMQTVKLAEDFLLSSDGTVVGLDLSGDPTVGHGKDLLAALQKAKNCGLKLALHLSEVPSQIDETELLLNLPPDRIGHGTFLHPDVGGSDSLVDKVCKQNIPIEICLTSNVKGQTVPSYDKHHFKYWYNRGHPCVLCTDDKGVFCTDLSQEYQLAASTFGLTKEAVWILSQQAIGYTFAPEPIKQRLEKTWAELKQQILQ

SEQ ID NO: 2408 - protein, 125 aa, Mus musculus
LKQHAAVSEKLLSLLPEYVVPYTIHLLAHDPDYVKVQDIEQLKDVKECLWFVLEILMAKNENNSHAFIRKMVENIKQTKDAQGPDDTKMNEKLYTVCDVAMNIIMSKSTTYSLESPKDPVLPARF

SEQ ID NO: 2409 - protein, 111 aa, Mus musculus
LLSLLPEYVVPYTIHLLAHDPDYVKVQDIEQLKDVKECLWFVLEILMAKNENNSHAFIRKMVENIKQTKDAQGPDDTKMNEKLYTVCDVAMNIIMSKSTTYSLESPKDPVL

SEQ ID NO: 2410 - protein, 125 aa, Mus musculus; identical to SEQ ID NO: 2408

SEQ ID NO: 2411 - protein, 111 aa, Mus musculus; identical to SEQ ID NO: 2409

SEQ ID NO: 2412 - protein, 125 aa, Mus musculus; identical to SEQ ID NO: 2408

SEQ ID NO: 2413 - protein, 111 aa, Mus musculus; identical to SEQ ID NO: 2409

SEQ ID NO: 2414 - protein, 67 aa, Canis familiaris
NIAMTAGWLVLAIAMVRFYMEKGTHKGLYKSIQKTLKFFQTFALLEIVHCLIGIVPTSVIVAGVQVS

SEQ ID NO: 2415 - protein, 54 aa, Canis familiaris
WLVLAIAMVRFYMEKGTHKGLYKSIQKTLKFFQTFALLEIVHCLIGIVPTSVIV

SEQ ID NO: 2416 - protein, 67 aa, Canis familiaris; identical to SEQ ID NO: 2414

SEQ ID NO: 2417 - protein, 54 aa, Canis familiaris; identical to SEQ ID NO: 2415

SEQ ID NO: 2418 - protein, 266 aa, Danio rerio
MARGFIDCHCHISASEFTTDTDDVLLRAKKAGVKALVAVTEGASEFEKVIQLSKTYPGFVFPCFGIHPLQGSGQDLHSVRVQDLDPFLYLFQTYKDDIVAIGEIGLDFTPWYSSITQERDEQMKVFIKQLEISKELDLPVNVHSRSSAKVTIATMKELGIRQALLHNFAGKPSVAMEGVQAGFCFSFPPAVSKNEQRAKLIRQIPLEHVCLETDSPALGLDKHVRNEPSNVTISCEYIAKVKGISSDVVMEVTTQNALRLFSKLKI

SEQ ID NO: 2419 - protein, 121 aa, Rattus norvegicus; identical to SEQ ID NO: 179

SEQ ID NO: 2420 - protein, 177 aa, Rattus norvegicus
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAV

SEQ ID NO: 2421 - protein, 198 aa, Pinus taeda
LVVEVSIAVGSLNIGDFIPYLDCLDLQGIKRALKKANARFDAFAEKMIDEHINASTIRNGEADAGCHVKDIIDVLLEMAKNDNTGAKVTREIIKAITYELFSAGMETSANVLEWAMSELLRHPHAMKKLQQEIESVVGQQGTVKESDLASIVYLHCVVKETLRLYPSLPLALPHESLEAVTVGGYYIPKKTMVIMNLW

SEQ ID NO: 2422 - protein, 75 aa, Pinus taeda
MKKLQQEIESVVGQQGTVKESDLASIVYLHCVVKETLRLYPSLPLALPHESLEAVTVGGYYIPKKTMVIMNLWAI

SEQ ID NO: 2423 - protein, 100 aa, Mus musculus
VTQHCSGEACFLAELLEFAEIIFAIYHENTKSVSDITSIQSCKDYLLGIVKVPTKDLLVKRSGITGWYPVILPEDKGLPQDLDLMQKIVGGLELSVSFAH

SEQ ID NO: 2424 - protein, 100 aa, Mus musculus; identical to SEQ ID NO: 2423

SEQ ID NO: 2425 - protein, 100 aa, Mus musculus; identical to SEQ ID NO: 2423

SEQ ID NO: 2426 - protein, 587 aa, Oncidium hybrid
  Oncidium hybrid cultivar
MLCLSLNSSSTSPPKLPLHHSFSRRGIRSWVRSPCVQRKKLGFWSSPKAVLSAVSGAGSEAGKVEEAEEYDAIVIGSGIGGLVAATQLAVKGARVLVLEKYVIPGGSSGFFQRDGFTFDVGSSVMFGFSDKGNLNLITQALEAVDCKLRTIPDPTTVHFHLPDNLSIRVHREYDMFISELVNYFPHEKEGIRRFYNECWKIFNSLNSLELKSLEEPMYLFGQFFRKPVECLTLAFYLPQNAGDIARKFIKDPQLLSFIDAECFIVSTVKALHTPMINASMVLCDRHFGGINYPVGGVGGIAKALANGLVNKGSKLLYKANVTKILLKDGKAVGVKLSNGREFFAKTVISNATRWDTFGKLLKVEDIPQEEKNFKKIYLKAPSFLSIHMGVKAFVLPPDTDCHHFILEDNWGRLELPYGSIFLSIPTVLDPSLAPEGHHIFHIFTTSSIENWEGLSHKEYEEKKELVADEIITRLEKKLFPGLKDSVVLKEVGTPKTHRRFLARDSGTYGPMPRKVPKGLLGMPFNTTAINGLYCVGDSCFPGQGVIAVAFSGVMCAHRVAADLGFEKKAPVLDAALLRLLGWLRTVA

SEQ ID NO: 2427 - protein, 587 aa, Oncidium hybrid
  Oncidium hybrid cultivar
MLCLSLNSSSTSPPKSPLHHSFSRRSMRSWVCSPRVQRKKLGFWSSPKAVLSAVSGAGSEAGKVEEAEEYDAIVIGSGIGGLVAATQLAVKGARVLVLEKYVIPGGSSGFFQRDGFTFDVGSSVMFGFSDKGNLNLITQALEAVDCKLRTIPDPTTVHFHLPDNLSIRVHREYDMFISELVNYFPHEKEGIRRFYNECWKIFNSLNSLELKSLEEPMYLFGQFFRKPVECLTLAYYLPQNAGDIARKFIKDPQLLSFIDAECFIVSTVKALHTPMINASMVLCDRHFGGINYPVGGVGGIAKALANGLVNKGSKLLYKANVTKILLKDGKAVGVKLSNGREFFAKTVISNATRWDTFGKLLKVEDIPQEEKNFKKIYLKAPSFLSIHMGVKAFVLPPDTDCHHFILEDNWGRLELPYGSIFLSIPTVLDPSLAPEGHHIFHIFTTSSIENWEGLSHKEYEEKKELVADEIITRLEKKLFPGLKDSVVLKEVGTPKTHRRFLARDSGTYGPMPRKVPKGLLGMPFNTTAINGLYCVGDSCFPGQGVIAVAFSGVMCAHRVAADLGIEKKAPVLDAALLRLLGWLRTVA

SEQ ID NO: 2428 - protein, 539 aa, Oryza sativa
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKPYFFSVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 2429 - protein, 692 aa, Staphylococcus carnosus
MKNLLKKFFGQLQRIGKALMLPVAILPAAGILLTFGNAMHNEQILHFAPWMQHHYIQLISQIMEASGQVIFDNLPLLFAMGTALGLAGGDGVAGIAALVGYLIMSATMGKIAGITIDDIFSYADGAKTLGQSAKDPAHALVLGIPTLQTGVFGGIIIGALAAWCYNKFYNIQLPQFLGFFAGKRFVPIITSLVAIVTGIVLSFVWPPVQDGLNNLSNFLLGKNLALTTFIFGIIERSLIPFGLHHIFYAPFWFEFGHYVNESGNLVRGDQRIWMAQYQDGVPFTAGAFTTGKYPFMMFGLPAAAFAIYRQAKPERRKVVGGLMLSAALTSFLTGITEPLEFSFLFVAPILYVAHVILAGTSFLIMHLLHVQIGMTFSGGFIDYILYGLLSWDRSNALLVIPVGIAYALIYYFLFTFLIKKLNLKTPGREDKEVESKDVSVSELPFEVLEAMGNKDNIKHLDACITRLRVEVRDKGLVDVEKLKQLGASGVLEVGNNMQAIFGPKSDQIKHDMQQIMDGKITSPAETTVTEDGDVETAEIVAEGGAVIYAPITGEAVDLSEVPDKVFSAKMMGDGIAIKPETGEVVAPFDGKVKMIFPTKHAIGLESKDGIELLIHFGLETVKLDGEGFEILVKENDNIVLGQPLMKVDLNYIKEHADDTITPIIITNAGSANIEVLHTGKVEQGEKLLLVNN

SEQ ID NO: 2430 - protein, 86 aa, Ophiophagus hannah
MKTLLLTLVVVTIVCLDLGHTLICVKQYTIFGVTPEICADGQNLCYKTWHMVYPGGYDHTRGCAATCPKMKNHDTVHCCTTDKCNL

SEQ ID NO: 2431 - protein, 893 aa, Dictyostelium discoideum
MPQKEVTIPVPAKGGSNKEEDKKDNKDTEEKNTTTNTTTKDNKKDKKKDKKEETLSPEDEKLKNDLELLVERSRDEKEEIALAALEALKTEIRSSTSSMTSVPKPLKFLRNHYSTLVDIYKNSKEGKAKTSLADILSVLAMANGNDERDTLKYKLLGSGEAIASWGHEYVKHLATEIGVEYDIKKEENQSVEDLLKLVDEIVPFQMTHNAEPEACDLLLEVEQLSKIFQYIDENNYSRVCLYLFKCSYYVPGPDDINILKVCVEIYIKMKQYPDALRVAMKISDPELITEIFKLVENNKSILQQLGFLVARQKIVPDNFNYDSISDIINNSKLSEYFMNLATDLDIREPKLPEEIFQSHLDSTSAIADSARMNLASSFVNAFVNAGFGKDKLMTAEEDTKWWFKNRELGILSTVASTGMVVLWDIDGGLTKIDKFLYSQEKHCSNGALMAIGMLTSGIRSEMDPALSLLAEHINSSNTGTRISAIFGLGLAYAGTQRQDLMSLLSPCLDDDKEKMEFIGIVGLALGLIFIGSCDPELSTLFVQTLIQRGTAASESHARFLHLGLGLLYLGKQDAAELALETLKAIEGKGGEYARLTVEACAYAGTGNVLKVQNMLHFCSDGQENPHHGLAVLSIALIAMGEELGSDMCLRMFDHLLQKGNVHIKRAIPLALGLLSPSNPRIAIMDILSKLSHDNDPEVAQGAILSLGLIGAGTNNARIGGMLRALAVFYGKDVHLFFVRIAQGLLHLGKGTMTINPYHSDRTLMSPVAVGGLLALLHAGLDIKNILSTQSHYLFFSIVCSMYPRMLMTLDEDLKPLPVSVRVGQSVDIVGLAGKPKTITGFQTHTTPVLLGYNERAELATDDYIPLTNILEGIVILKPNPNASVTSPLASKKN

SEQ ID NO: 2432 - protein, 298 aa, Dictyostelium discoideum
MAGDLTPSLFLKYGFGGALSCSITHSLVVPLDVVKTLLQTNPGKYTGMMNGFSTVIKEQGPSGLLQGLGPTAVGYALQGFLKFGFYEVFKKTYADAVGEKADQFRIPIWLAASATAEVIADIALCPNEAVRIRLVAEPTFAKSPVEAFGKIFKQEGVLGFYKGLPPILLKQVPYTMAKFAVFEFTAENVYKGLAASGKPKESLTDGQKLSVSLGSGIVAGIVAAIVSQPADTILSKINQEKTDGGVVKAIGNIMRRLGVRGLFLGLPTRCFMVGTLTAGQFFIYDGIKQMLGLTPAKK

SEQ ID NO: 2433 - protein, 100 aa, Dictyostelium discoideum
MDKVKALIKAHKLIIFSKTTCPYCISVKDLFKKLKVVPFVVELDLESDGSELQSAAGQISGVRTVPQVFINEKFIGGCDATTKLHSQGKLIPLLQEAGFL

SEQ ID NO: 2434 - protein, 480 aa, Dictyostelium discoideum
MKNILLLGSGFVAKPALDYLLKREDYFVTIVSLFQNELDSITKGHDTSKFKTIQLDVMNKLNELEEYFPKSDCVISLIPATLHSTVAKLCIKHKTHLVTASYISDDMKALSEEAKEAGVLLLNELGLDPGIDHMSSMKIIDHAKENGGKVTSFVSWCGALPSTECADNPFGYKFSWSPRGVLSSATLSANFLWEGHNEEVPANIKWAVLQPIVVEDSNGVKMEFDGVPNRNSFPYIEQYNLNAKDVTTMFRGTLRWKGGFGIMIRALVAVGLFSTEVDARLAVEGGISWRNYLVQLLGCNDNDSDLLYCVESTIKEYFEKLKTERDGLQFHFPIIPRDIEKDVQHAVEGFKWLGLLSADEKVVNKNTPIDSLCALLEKKLSYKAGERDVVVLEHNFVVQYADRTEKEVSSLICYGIPNGSSATSLTVGVPVGIATELIADGKTTTRGVVGPVTPEFYLPILEKLKSENIEMIETKQEIKK

SEQ ID NO: 2435 - protein, 136 aa, Dictyostelium discoideum
MEGDAPVIAANPLEKNTDPMVALQKVIKESLAVQGVARGLHETVKALDKRTARLCVLASNCDEPNFVRLVKALATEHNIPLIEVPDNKALGEWAGLCKLDKDLAARKVVACSTLVIKTFGKESDDYKFLMEYISKQ

SEQ ID NO: 2436 - protein, 584 aa, Dictyostelium discoideum
MASINTESDDYHPIVILIDELKNEDIQLRLNSIKKLQSIAKALGPERTRTELIPYLQDSVLEDEDEVLVVLSEELGNLIEFVGGAEHAVCLLPPLQILAGAEELVVREKAVESLCKIAKEIPTSSFEESFLPLLFSLSKADWFTSRTSACGLFTVSYPRANAEMKKSLRKTFGGLCHDDTPMVKRAAATNLGSFAKQIEKESVKSEILPLFQSLSTDEQDSVRLLGVENCALLGSMLTNEENIQFILPTIKASSLDKSWRVRYMVARLLKELCESMGTEITKTELIGAFVKLLKDTEAEVRTEASLRIADVCSLLTKEMNIKTILPCVKDLVSDSSQHVRAALAQVIMSLAPIYGKEDTLTHLLELFLHLLKDDFPDVRLNIISKLDQVSKVIGIEMLSQSLLPAIVELAEDHQWRVRLAIIDYIPLLASQLGVEFFDEKLGNLCMTWLGDPVFSIREAATNNLKKLTEVFGVDWAKNNIIPKVLSLHSHPNYLYRMTTLFSISTLSTVVGGDVISSSMVPLLAKMVSDKVPNIRFNVAKTFQTIIPLLDSTIVQSRVKPLLVKLHEDTDKDVKFYASQALQLC

SEQ ID NO: 2437 - protein, 60 aa, Dictyostelium discoideum
LVSKYRPSIPIIAVTSWSYTVKHLLATRGAIPFLVESLVGTDKLVESCLEYAMKHNLCKK

SEQ ID NO: 2438 - protein, 53 aa, Dictyostelium discoideum
IPIIAVTSWSYTVKHLLATRGAIPFLVESLVGTDKLVESCLEYAMKHNLCKKG

SEQ ID NO: 2439 - protein, 37 aa, Dictyostelium discoideum
LSKYYELVDTVILALKKKPIIFLHIFHHMAMVPVTWQ

SEQ ID NO: 2440 - protein, 30 aa, Dictyostelium discoideum
LVDTVILALKKKPIIFLHIFHHMAMVPVTW

SEQ ID NO: 2441 - protein, 149 aa, Synechocystis sp.
MAGTEISAITTKLLEAKKAKGITFADLEQLLGRDEVWIAAVIYRQASASVDEAEKLLHCLGLSDDLVPELTAPSVKGLGPVVPTDPLIYRFYEIMQVYGMPMKEVIHEKFGDGIMSAIDFTLDIEKEADPKGDRVKVTMNGKFLPYKKW

SEQ ID NO: 2442 - protein, 190 aa, Dictyostelium discoideum
GCVTALLWWAAISVDLWITIKKIKISKKLFIIYTIAVNIVTIVLTFGPVGSKQYGYIDAAIGCWLMDLKYQVGYFWAPVGFCLCVGCVSIVLILKEIYNVSDAVKKKLLAKHLKPLMLIILMLTEFIYMFIFYSYTTSKKNHYHDIIEEYVVCLFVHAANPSVCKIGSTISPSAHFFFHLCIRLMGLEVL

SEQ ID NO: 2443 - protein, 116 aa, Dictyostelium discoideum
LFIIYTIAVNIVTIVLTFGPVGSKQYGYIDAAIGCWLMDLKYQVGYFWAPVGFCLCVGCVSIVLILKEIYNVSDAVKKKLLAKHLKPLMLIILMLTEFIYMFIFYSYTTSKKNHYH

SEQ ID NO: 2444 - protein, 140 aa, Dictyostelium discoideum
TKASDAKSALSNLTTSIPAGVLVIGILFVIFTVVGCFVAYKEKLVGLVIYCAVMLILLVILIGVGGKAITLHNDDIINEVGGAWEHVANGTKNSTLTRLENFLKCCKWSNVSIDSSDLCPKDGDKIKYEGHYCGEALSDQ

SEQ ID NO: 2445 - protein, 71 aa, Dictyostelium discoideum
FVAYKEKLVGLVIYCAVMLILLVILIGVGGKAITLHNDDIINEVGGAWEHVANGTKNSTLTRLENFLKCCK

SEQ ID NO: 2446 - protein, 122 aa, Dictyostelium discoideum
HIFKELVFKKFISSSVVYLILITLLFCISLVYHWEVRKPYTLMALASMIPQLTQALYKVELTLTGVMDKGTMSHNVTPLGGGIFYILNVISYTSFYCGLAIDVVVASGEKYKRLKKRGEKYH

SEQ ID NO: 2447 - protein, 88 aa, Dictyostelium discoideum
HWEVRKPYTLMALASMIPQLTQALYKVELTLTGVMDKGTMSHNVTPLGGGIFYILNVISYTSFYCGLAIDVVVASGEKYKRLKKRGEK

SEQ ID NO: 2448 - protein, 309 aa, Rattus norvegicus
MAADEDELNLLVIIVDTNPIWWGKQALKESQFTLSKCMDAVMVLANAHLFMNRSNQLAVIASHIQESRFLYPGKNGRLGDFFGDPGNALPDCNPSGSKDGKYELLTAANEVIAEEIKDLMTKSDIKGQHTETLLAGSLAKALCYIHRASKAVKDNQEMKSRILVIKAAEDSALQYMNFMNVIFAAQKQNILIDACVLDSDSGLLQQACDITGGLYLKVPQMPSLLQYLLWVFLPDQDQRSQLILPPPIHVDYRAACFCHRSLIEIGYVCSVCLSIFCNFSPICTTCETAFKISLPPVLKAKKKKQKVSL

SEQ ID NO: 2449 - protein, 151 aa, Rattus norvegicus
GNTFQLYKSADHPTLEKVLEVQPGKLELILDEMKQILTPMAQKEAVIKHSLVHKVFLDFFTYAPPKLRSELIEAIREAVVYLAHTHDGARVAMHCLWHGTPKDRKVIVKTMKTYVEKIANGQYSHLVLLAAFDCIDDTKLVKQIIISEVIS

SEQ ID NO: 2450 - protein, 126 aa, Rattus norvegicus
LEKVLEVQPGKLELILDEMKQILTPMAQKEAVIKHSLVHKVFLDFFTYAPPKLRSELIEAIREAVVYLAHTHDGARVAMHCLWHGTPKDRKVIVKTMKTYVEKIANGQYSHLVLLAAFDCIDDTKL

SEQ ID NO: 2451 - protein, 61 aa, Vibrio parahaemolyticus
MTGVLFMLNAKEVTKLTPYMIVGAILWFAVLKSGVHATLAGVVIGFAIPLKGKQGEHSPLK

SEQ ID NO: 2452 - protein, 60 aa, Vibrio parahaemolyticus
LFMLNAKEVTKLTPYMIVGAILWFAVLKSGVHATLAGVVIGFAIPLKGKQGEHSPLKHME

SEQ ID NO: 2453 - protein, 235 aa, Xenopus laevis
MALFSVPTPVTTILLDIEGTTTPITFVKDVLFPYIKENIKKYLLEHWQEKECQEDITQLQKQAEKDSHIDGFVPIPSAISDNETENMIQAVVDNVYWQMSLDRKTTALKQLQGHMWRSAYITGQLKGEVYEDVVPSIRQWRELGFKLYIYSSGSVEAQKLLFGFSIEGNLLKLLDGHFDTTVGHKVESKSYRNIADSIRCSPENILFLTDVVKDMPLYLVTQESYPEAVIRGVCC

SEQ ID NO: 2454 - protein, 67 aa, Arabidopsis thaliana
VKLYHLLCEVDRGSWVIKVTSSTKVHHLAQDDRLVEKIMRIYDKRLSSKLGHISFWCFPSPPGLTET

SEQ ID NO: 2455 - protein, 81 aa, Arabidopsis thaliana
VKLYHLLCEVDRGSWVIKVTSSTKVHHLAQDDRLVEKIMRIYDKRLSSKLGHISFWCFPSPPGLTETDDNCAPFVTLMDII

SEQ ID NO: 2456 - protein, 66 aa, Haemophilus influenzae
TFVMLVFSEIFPKTVAAMHAEKVSFFSSHILTSLLKIFYPLVWLMNIFTKSLMQIVGLKLDMQKQV

SEQ ID NO: 2457 - protein, 74 aa, Haemophilus influenzae
PKTVAAMHAEKVSFFSSHILTSLLKIFYPLVWLMNIFTKSLMQIVGLKLDMQKQVISSEELRSIVSEAGEATPN

SEQ ID NO: 2458 - protein, 675 aa, Staphylococcus carnosus
MWKKFFGQLQRIGKALMLPVAILPAAGLLLALGNAFQGDALQSLMPFIKAEGFQNVAKMMEGAGGIIFDNLAIIFALGVAIGLASGDGVAAIAAFVGFIVLNKTMGMFLGVTPEKAADAATGFANVLGIPTLQTGVFGGIIIGALAAWCYNKFYNISLPSYLGFFAGKRFVPIMMATCSFILAFPMAIIWPSIQGGLNAFSEGLLASNTGLAVFLFGFIKRLLIPFGLHHIFHAPFWFEFGSYKNAAGQIIHGDQRIFIEQIRDNVPLTAGKFMQGEFPVMMFGLPAAALAIYQTAKKENKKVVAGLMLSGALTSFLTGITEPLEFSFLFVAPLLFFIHAVLDGLSFLILYLLDLHLGYTFSGGFIDFFLLGILPNKTQWWLVIPVGLVYAAIYYIIFRFLIVKFNFKTPGREDKEVKSSNVAASELPFKVLDAMGGKANIKHLDACITRLRVEVNDKAKVDVQELKDLGASGVLEVGNNMQAIFGPKSDQIKHDMQQIMDGKITSPEETTVTEEGDKETAEIAAAGGGVVYAPIKGEVVDISEVPDKVFSEKMMGDGIAIKPETGEVVAPFDGVVKMVFPTKHAIGLESKDGIELLIHFGLETVKLEGKGFDILVKENDNIVLGQPLMKVDLDYIKEHADSTITPIVVTNLNGRTMEVLQHGEVKQGDKVILVK

SEQ ID NO: 2459 - protein, 156 aa, Haemophilus influenzae
MKKLLSIFLMAFSLNAFAQTNLADVQLKDLNNQPVTLSQYKGKPVYVKMWASWCPICLAGLAEIDDLSAEKDRNFEVITIVSPDHKGEKDTADFIEWYKGLEYKNITVLLDEKGEIIDKARVRGYPFNLFLDSDLNLKKTVPGHLGAEQIRVFAEK

SEQ ID NO: 2460 - protein, 196 aa, Mus musculus
LNNVKLLNKIYEAQPEISPAFWTREFIPLPRLLAMVMVTTVPLVCNKIMFTQALNLDSIPVKHSALSLISDILKRALKTVDHCLDKETWQDSDVYTAEMMEEFVQLFREALGKILPDLNTVIWVWQSFKKQEIKEDHEKGKKSSSKTPAVSKAAQHDVAETILLKSVLLQVICLYQQVVPHVIMQYNFDFSKLLKG

SEQ ID NO: 2461 - protein, 177 aa, Mus musculus
FWTREFIPLPRLLAMVMVTTVPLVCNKIMFTQALNLDSIPVKHSALSLISDILKRALKTVDHCLDKETWQDSDVYTAEMMEEFVQLFREALGKILPDLNTVIWVWQSFKKQEIKEDHEKGKKSSSKTPAVSKAAQHDVAETILLKSVLLQVICLYQQVVPHVIMQYNFDFSKLLKGI

SEQ ID NO: 2462 - protein, 336 aa, Methanocaldococcus jannaschii
MILLEKTQEKKINDKEELIVKEEVETNWDYGCNPYERKIEDLIKYGVVVVDKPRGPTSHEVSTWVKKILNLDKAGHGGTLDPKVTGVLPVALERATKTIPMWHIPPKEYVCLMHLHRDASEEDILRVFKEFTGRIYQRPPLKAAVKRRLRIRKIHELELLDKDGKDVLFRVKCQSGTYIRKLCEDIGEALGTSAHMQELRRTKSGCFEEKDAVYLQDLLDAYVFWKEDGDEEELRRVIKPMEYGLRHLKKVVVKDSAVDAICHGADVYVRGIAKLSKGIGKGETVLVETLKGEAVAVGKALMNTKEILNADKGVAVDVERVYMDRGTYPRMWKRKK

SEQ ID NO: 2463 - protein, 124 aa, Methanocaldococcus jannaschii
MLKYLGKHLILELWGCDPKALDDIEGIEKMLVDSVKACGATLICVRTHKFSPQGATGVAVLAESHIAIHTYPEYGYAALDVFTCGEHTDPYKALEVIREFLKPKSIQIIDLKRGLMENGTFELK

SEQ ID NO: 2464 - protein, 668 aa, Methanocaldococcus jannaschii
MKSYEIALIGNPNVGKSTIFNALTGENVYIGNWPGVTVEKKEGEFEYNGEKFKVVDLPGVYSLTANSIDEIIARDYIINEKPDLVVNIVDATALERNLYLTLQLMEMGANLLLALNKMDLAKSLGIEIDVDKLEKILGVKVVPLSAAKKMGIEDLKKAISIAVKDKKTAEIKYPNFEPYIKKITSILQKDEDLKKYNLRYLAIKLLENDKYVEEIVKNSKVWNELKPVLDSIINELSKKYGEAELGIVEERYKVIDKIVKEVMKKTSGKLTTTEMLDDVLTDEKIGTLLIIPFLWMLFKFTFDVSKPFSAMIEYFFGFLSEVVKSSISNKFIASLLADGIISGVGAVLVFFPILAFLFFAISFLEDSGYMARIPFITDRIMNKFGLPGKAVISMVMGFGCNVPAIMATRTIEDEKDRILTILINPLLSCSARLPIYALFAGALFSKYQGVVILSMYALGVVLALITAFLFRKLIFKTSPSYLIVELPPYHIPHLNVVLKNTWERVYDFLRKAGTIIVFGVILVWVLSVYGPSGYLGEEVFENPQLIANSWVAVIGKTLAPLFSPMGWDWRACSALVFGIIAKEVVVGSLAMLYGTGEENLSSVIAHAFSPVSAYAFMAFSLIYLPCIATLAVIKQEIGWKWALFAVTYEMILAYVVALVISVIGNLLF

SEQ ID NO: 2465 - protein, 311 aa, Methanocaldococcus jannaschii
MIFVITVLSGGTGTPKLLQGLKRVVNNEELAVIVNTGEDTWIGDLYLSPDVDTVLYTLADLINEETWYGVKEDTFYTHEQLKNLGFDEVLRIGDKDRALKMHKTYYLKRGHKLSEVVDMEKVALGIKAKVIPMTDDRVETKILAKVDGKVDLLKFHDFWVKRKGDVEVLDVIYENSLYAKPCEKAVEAIKNSDLVIIGPSNPITSIGPILSLNGIKELLKDKKVVVVSPIVGNSAVSGPAGKLMKAKGYDVSVKGIYEFYKDIVDVLVIDNVDKEIAKEIPCEVLITNTIMKTLDDKVRLAKNIIEFCGSL

SEQ ID NO: 2466 - protein, 67 aa, Bos taurus
TSLLFYILPMTVISVLYYLMGLKLKKDQHLEADKVTANIQRPSRKSVTKMLFVLVLVFAICWAPFHI

SEQ ID NO: 2467 - protein, 58 aa, Bos taurus
TVISVLYYLMGLKLKKDQHLEADKVTANIQRPSRKSVTKMLFVLVLVFAICWAPFHID

SEQ ID NO: 2468 - protein, 123 aa, Bos taurus
GAVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGKYIVCSSALGLYQ

SEQ ID NO: 2469 - protein, 113 aa, Bos taurus
VFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGKYIVC

SEQ ID NO: 2470 - protein, 356 aa, Bos taurus
MAAAKPENLSLVVHGPGDLRLENYPIPEPGPNEVLLKMHSVGICGSDVHYWQHGRIGDFVVKKPMVLGHEASGTVVKVGSLVRHLQPGDRVAIEPGAPRETDEFCKIGRYNLSPTIFFCATPPDDGNLCRFYKHNANFCYKLPDNVTFEEGALIEPLSVGIHACRRAGVTLGNKVLVCGAGPIGLVSLLAAKAMGAAQVVVTDLSASRLSKAKEVGADFILQISNESPQEIAKKVEGLLGSKPEVTIECTGVETSIQAGIYATHSGGTLVLVGLGSEMTSVPLVHAATREVDIKGVFRYCNTWPMAISMLASKSVNVKPLVTHRFPLEKALEAFETSKKGLGLKVMIKCDPNDQNP

SEQ ID NO: 2471 - protein, 140 aa, Bos taurus
FDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSE

SEQ ID NO: 2472 - protein, 84 aa, Bos taurus
LEWTKICEKSTKVITFIDLAGHEKYLKTTVFGMTGHLPDFCMLMVGSNAGIVGMTKEHLGLALALNVPVFVVVTKIDMCPANIL

SEQ ID NO: 2473 - protein, 140 aa, Bos taurus; identical to SEQ ID NO: 2471

SEQ ID NO: 2474 - protein, 84 aa, Bos taurus; identical to SEQ ID NO: 2472

SEQ ID NO: 2475 - protein, 290 aa, Bos taurus
MILFNLLETQLTRVHSFQEMIKKASVYRHPLANHLMDPEVQKESREDGDDRTVVAEIMRRCFVPAFVTTIPWEGFHFAGHEIRINEATDCYGAVVWPSALVLCYFLETNVKQYNLVDKNVIEIGAGTGLVSIVASLLGAHVTATDLPELLGNLQYNISRNTKTKAKHLPQVKELSWGVALDKNFPRASINFDYILAADVVYAHPFLEELLVTFDHLCKETTVILWVMKFRLEKENKFVDRFEQLFDLEEISSFPSLNIKLYKAMKKNQKSACYPQRRMWKAKPISGRLLL

SEQ ID NO: 2476 - protein, 111 aa, Bos taurus
VMSFFSKVSWNLRLQKQEPLKNVFFILAETARDPSVKKRHMVMRGLGTMACETPDKVRKYKKIILDLLVHGLYDPVSSEVIHESMKTLTIILGKMQGKALGSFFIDITLQT

SEQ ID NO: 2477 - protein, 88 aa, Bos taurus
FSKVSWNLRLQKQEPLKNVFFILAETARDPSVKKRHMVMRGLGTMACETPDKVRKYKKIILDLLVHGLYDPVSSEVIHESMKTLTIIL

SEQ ID NO: 2478 - protein, 164 aa, Arabidopsis thaliana
DSLLERTIKHMLFLQNVTKHAEKLSKSANEKMQQKETGMQGSSCAVEVGGHLQVSSIIVENLNKQGMVLIEFNLCLNSSPKFCECVLKVFLGIGQMLCEECGHFLEIANVIRSLDLVILRGFTETQGEKTWICFVTEVGSRITQFMKEIPKQIKVFSLVLIELW

SEQ ID NO: 2479 - protein, 158 aa, Arabidopsis thaliana
TIKHMLFLQNVTKHAEKLSKSANEKMQQKETGMQGSSCAVEVGGHLQVSSIIVENLNKQGMVLIEFNLCLNSSPKFCECVLKVFLGIGQMLCEECGHFLEIANVIRSLDLVILRGFTETQGEKTWICFVTEVGSRITQFMKEIPKQIKVFSLVLIELW

SEQ ID NO: 2480 - protein, 34 aa, Oxyuranus microlepidotus
VTANMSVSRTGKWLISSLVAKHLQAGMYGYLNIK

SEQ ID NO: 2481 - protein, 65 aa, Oxyuranus microlepidotus
NITHGKAVEPGQVYTYKWTVLDTDEPTVKDSECITKLYHSAVDMTRDIASGLIGPLLVCKLKALS

SEQ ID NO: 2482 - protein, 58 aa, Oxyuranus scutellatus
LEQNHYKVSTINLVGGASVTANMSVSRTGKWLISSLVAKHLQAGMYGYLNIKDCGNPD

SEQ ID NO: 2483 - protein, 34 aa, Oxyuranus scutellatus; identical to SEQ ID NO: 2480

SEQ ID NO: 2484 - protein, 319 aa, Mus musculus
MLFWLLALLFLCAFLWNYKGQLKIADIADKYVFITGCDTGFGNLAARTFDKKGFRVIAACLTESGSAALKAKTSERLHTVLLDVTDPENVKKTAQWVKSHVGEKGLWGLINNAGVLGVLAPTDWLTVDDYREPIEVNLFGLINVTLNMLPLVKKARGRVINVSSIGGRLAFGGGGYTPSKYAVEGFNDSLRRDMKAFGVHVSCIEPGLFKTELADPIKTTEKKLAIWKHLSPDIKQQYGEGYIEKSLHRLKSNTSSVNLDLSLVVGCMDHALTSLFPKTRYIAGKDAKTFWIPLSHMPAVLQDFLLLKQKVELANPKAV

SEQ ID NO: 2485 - protein, 816 aa, Arabidopsis thaliana
MGGGDISHMSPEVKWIFEMAWYGETVRYDGLICEEHPPKLSSDGIWEKLIIKSAGLYFWQYRLPKLEIVILLVFFLWQGFNILFKKLGLSIPKLSSMMLAGLLLNVLVTLSGENSIIADILVTKNRIDVAGCLGSFGFLIFWFLKGVRMDVKRIFKAEAKARVTGVAAVTFPIVVGFLLFNLKSAKNRPLTFQEYDVMLLMESITSFSGIARLLRDLGMNHSSIGRVALSSALVSDIVGLLLLIANVSRSSATLADGLAILTEITLFLVIAFAVVRPIMFKIIKRKGEGRPIEDKYIHGVLVLVCLSCMYWEDLSQFPPLGAFFLGLAIPNGPPIGSALVERLESFNFGIILPLFLTAVMLRTDTTAWKGALTFFSGDDKKFAVASLVLLIFLLKLSVSVIVPYLYKMPLRDSIILALIMSHKGIIELSFYLFSLSLKLVTKDTFSILVLSIVLNSLLIPMAIGFLYDPSKQFICYQKRNLASMKNMGELKTLVCIHRPDHISSMINLLEASYQSEDSPLTCYVLHLVELRGQDVPTLISHKVQKLGVGAGNKYSENVILSFEHFHRSVCSSISIDTFTCIANANHMQDDICWLALDKAVTLIILPFHRTWSLDRTSIVSDVEAIRFLNVNVLKQAPCSVGILIERHLVNKKQEPHESLKVCVIFVGGKDDREALAFAKRMARQENVTLTVLRLLASGKSKDATGWDQMLDTVELRELIKSNNAGMVKEETSTIYLEQEILDGADTSMLLRSMAFDYDLFVVGRTCGENHEATKGIENWCEFEELGVIGDFLASPDFPSKTSVLVVQQQRTVANNN

SEQ ID NO: 2486 - protein, 272 aa, Acinetobacter sp.
MSLPILSTTYAAENTVPASKSTYVVKNLNIGDLPVKTLVPITAKTREQALAQAKVIAENKDADIAEFRIDLLEFASDTKKVIALGQELNQILKDKPLLATIRTSNEGGKLKVTDQEYEKIYSEYLKKPFMQLLDIEMFRDQAAVAKLTKLAHQKKVLVVMSNHDFDKTPSEQEIVSRLLKQDQMGADILKIAVMPKSKQDVFTLMNATLKVSEQSTKPLLTMSMGRLGTISRIATANMGGSLSFGMIGEASAPGQIDVTALKQFLKTVQPTP

SEQ ID NO: 2487 - protein, 217 aa, Acinetobacter sp.
MSYHKLTRDQIAQRVAQDIPEGSYVNLGIGLPTKIASYLPADKDVFLHSENGLLAFGPPPAAGEEDPELINAGKEYVTMLEGGCFFHHGDSFAMMRGGHLDICVLGAFQIAANGDLANWHTGAPDAIPSVGGAMDLAVGAKKVFVTTDHVTKKGEPKIVAELTYPATGQKCVDRIYTDLCIIDVVPEGLKVIEKVEGLSFEELQRLTGATLIDATQG

SEQ ID NO: 2488 - protein, 34 aa, Pseudonaja textilis; identical to SEQ ID NO: 2480

SEQ ID NO: 2489 - protein, 56 aa, Pseudonaja textilis
EPGQVYTYKWTVLDTDEPTVKDSECITKLYHSAVDMTRDIASGLIGPLLVCKHKAL

SEQ ID NO: 2490 - protein, 686 aa, Helicobacter pylori
MQEYHIHNLDCPDCASKLERDLNELDYVKKAQINFSTSKLFLDTSDFEKVKAFIKQNEPHLSLSFKEATEKPLSFTPLIITIMVFLGAILILHLNPSPLIEKAMFFVLALVYLVSGKDVILGAFRGLRKGQFFDENALMLIATIAAFFVGAYEESVSIMVFYSAGEFLQKLAVSRSKKSLKALVDVAPNLAYLKKGDELVSVAPEDLRVNDIVVVKVGEKVPVDGVVVKGESLLDERALSGESMPVNVSENSKVLGGSLNLKAVLEIQVEKMYKDSSIAKVVDLVQQATNEKSETEKFITKFSRYYTPSVLFIALMIAVLPPLFSMGSFDEWIYRGLVALMVSCPCALVISVPLGYFGGVGAASRKGILMKGVHVLEVLTQAKSIAFDKTGTLTKGVFKVTDIVPQNGHSKEEVLHYASCSQLLSTHPIALSIQKACEEMLKDDKHQHDIKNYEEVSGMGVKAQCHTDLIIAGNEKMLDQFHIAHSPSKENGTIVHVAFNQTYVGYIVISDEIKDDAIECLRDLKVQGIENFCILSGDRKSATESIAQTLGCEYHASLLPEEKTSVFKTFKERYKAPAIFVGDGINDAPTLASADVGIGMGKGSELSKQSADIVITNDSLNSLVKVLAIAKKTKSIIWQNILFALGIKAVFIVLGLMGVASLWEAVFGDVGVTLLALANSMRAMRA

SEQ ID NO: 2491 - protein, 117 aa, Helicobacter pylori
FDEWIYRGLVALMVSCPCALVISVPLGYFGGVGAASRKGILMKGVHVLEVLTQAKSIAFDKTGTLTKGVFKVTDIVPQNGHSKEEVLHYASCSQLLSTHPIALSIQKACEEMLKDDK

SEQ ID NO: 2492 - protein, 111 aa, Helicobacter pylori
WIYRGLVALMVSCPCALVISVPLGYFGGVGAASRKGILMKGVHVLEVLTQAKSIAFDKTGTLTKGVFKVTDIVPQNGHSKEEVLHYASCSQLLSTHPIALSIQKACEEMLK

SEQ ID NO: 2493 - protein, 314 aa, Methylobacterium extorquens
MTKKVVFLDRESLDATVREFNFPHEYKEYESTWTPEEIVERLQGAEIAMINKVPMRADTLKQLPDLKLIAVAATGTDVVDKAAAKAQGITVVNIRNYAFNTVPEHVVGLMFALRRAIVPYANSVRRGDWNKSKQFCYFDYPIYDIAGSTLGIIGYGALGKSIAKRAEALGMKVLAFDVFPQDGLVDLETILTQSDVITLHVPLTPDTKNMIGAEQLKKMKRSAILINTARGGLVDEAALLQALKDGTIGGAGFDVVAQEPPKDGNILCDADLPNLIVTPHVAWASKEAMQILADQLVDNVEAFVAGKPQNVVEA

SEQ ID NO: 2494 - protein, 721 aa, Synechocystis sp.
MTQSSPLKTQQMQVGGMDCTSCKLKIEGSLERLKGVAEASVTVATGRLTVTYDPKQVSEITIQERIAALGYTLAEPKSSVTLNGHKHPHSHREEGHSHSHGAGEFNLKQELLPVLTAIALFTIAILFEQPLHNTPGQIAEFAVIIPAYLLSGWTVLKTAGRNILRGQIFDENFLMTIATLGALAIHQLPEAVAVMLFFRVGELFQEYSVGRSRRSIKALLEARPDTANLKRNGTVQQVSPETVQVDDLILVKPGEKVPLDGEILGGTSQVDTSALTGESVPGTVKPGDTILAGMINQSGVLTIRVTKLFSESSIAKVLDLVENASSKKASTEKFITQFARYYTPVIVFLSLAVALLPPLFIPGADRADWVYRALVLLVISCPCGLVISIPLGYFGGIGGAAKHGILIKGSTFLDSLTAVKTVVFDKTGTLTKGTFKVTQVVTKNGFSESELLTLAAKAESHSTHPIALSIREAYAQSIADSEVADYEEIAGHGIRAVVQNQVVIAGNDRLLHREKIDHDTCDVAGTVVHLAVDGRYGGYILIADEIKEDAVQAIRDLKRMGVEKTVMLTGDSEIVAQSVAQQIGLDAFVAELLPEEKVDEIEQLLDPSGKAKLAFVGDGINDAPVIARADVGIAMGGLGSDAAIETADVVLMTDAPSKVAEAIHVARKTRQIVVQNIVLALGIKALFIALGTIGLATLWEAVFADVGVALLAILNATRIAK

SEQ ID NO: 2495 - protein, 349 aa, Bos taurus
MKGLYFQQSSTNEEITFVFQERENLPVTEDNYVKLQVKACALSQINTKLLAEMKMEKEFFPVGREVAGIVLDVGSKVSFFQPDDEVVGILPLDSEDPGLCEAVRVHEHYLVHKPEKVTWTEAAGTIRDGLRVYTALHYLSHLSPGKSVLIMDGASALGTIAIQLAHHRGAKVISTACSLEDKQFLERFRPPIARVIDVSNGKAHVAESCLEETGGLGVDIVLDAGVRLYSKDDEPAEKLQLLPHKHDIITLLGVGGHWVTTEENLQLDPPDSHCLFLKGAAVAFLNDEVWNLSNVQQGKYLCILKDVMEKLSTGVFRPQLDEPIPLYEAKVTMEVVQKNQGRKKQVVQF

SEQ ID NO: 2496 - protein, 1010 aa, Bos taurus
MAARVLVIGNGGREHTLAWKLAQSTHVKQVLVTPGNAGTACSEKISNTDISISDHTALAQFCKDEKIEFVVVGPEAPLAAGIVGNLNSVGVRCFGPTAQAAQLESSKRFAKEFMDRHGISTARWRAFTKPKEACDFIMSADFPALVVKASGLAAGKGVIVAKSKEEACEAVREIMQGKAFGEAGETVVIEELLEGEEVSCLCFTDGRTVAPMPPAQDHKRLLEGDEGPNTGGMGAYCPAPQVSKDLLLKIKNNILQRTVDGMQEEGMPYTGVLYAGIMLTKNGPKVLEFNCRFGDPECQVILPLLKSDLYEVIQSILDGLLCTSLPVWLDNCAAVTVVMASKGYPGDYTKGVEITGFPEAQALGLEVFQAGTALKDGKVVTNGGRVLTVTAIRENLISALEEARKGLAAIKFEGAVYRKDIGFRAIAFLQQPRGLTYKESGVDIAAGNMLVQKIKPLAKATSRPGCDVDLGGFAGLFDLKAAGFTDPLLACGTDGVGTKLKIAQQCSKHDTIGQDLVAMCVNDILAQGAEPLFFLDYFSCGKLDLRTTEAVITGIAKACKKAGCALLGGETAEMPDMYPPGEYDLAGFAVGAMERDQKLPQLERITEGDAVIGIASSGLHSNGFSLVRKIVAKSSLEYSSPAPGGCGDQTLGDLLLTPTKIYSRSLLPVLRSGRVKAVAHITGGGLLENIPRVLPQKLGVNLDAQTWRVPRIFSWLQQEGHLSEEEMARTFNCGIGAALVVSEDLVKQTLQDIEQHQEEACVIGRVVACPKGSPRVKVEHLIETMQINGSVLENGTLRNHFSVQPKKARVAVLISGTGSNLQALIDSTREPSSLAHIVIVISNKAAVAGLDKAEKAGIPTRVINHKLYKNRAAFDTAIDEVLEEFSTDIVCLAGFMRILSGPFVRKWNGKMLNIHPSLLPSFKGSNAHEQVLDAGVTVTGCTVHFVAEDVDAGQIILQEAVPVKRGDTVETLSERVKLAEHKIFPSALQLVASGAVRLGENGRICWVTED

SEQ ID NO: 2497 - protein, 961 aa, Bos taurus
MAGGTGCVRLWGAARCWTLRRPLLAAAGGRVPTAARAWLPRGRRACDASPPWALWGQSPAAAGHWRGLWEANNRSGGGAFSGGEDASEGGAEDGASGVGGSAGGGEGPVITALTPMMIPDVFPHLPLIAVTRNPVFPRFIKIVEVKNKKLVELLRRKVHLAQPYAGVFLKKDDNNESDVVENLDEIYHTGTFVQIHEMQDLGDKLRMIVMGHRRVHINRQLEVEPEEPEGENKQKLRKKPKRGKKEAEEDGATKRPLEVVVGPGPSPAGEVLMVEVENVAHEDFQVTEEVKALTAEIVKTIRDIIALNPLYRESVLQMMQAGHRVVDNPIYLSDMGAALTGAESHELQEVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKHSDENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLVLIDEVDKIGRGYQGDPSSALLELLDPEQNANFLDHYLDVPVDLSKVLFICTANITETIPEPLRDRMEMINVSGYVAQEKLAIAERYLVPQARALCGLDESKAKLSSDVLTLLIKQYCRESGVRNLQKQVEKVLRKSAYKIVSGEAEFVEVTPENLQDFVGKPVFTVERMYDVTPPGVVMGLAWTAMGGSTLFVETSLRRPRDRDSDKGDKDGSLEVTGQLGEVMKESARIAYTFARAFLMQHDSANKFLVTSHIHLHVPEGATPKDGPSAGCTIVTALLSLALDRPVRQNLAMTGEVSLTGKVLPVGGIKEKTIAAKRAGVTCIVLPAENKKDFYDLAAFITEGLEVHFVEHYREIFDIAFPEERAEALAVER

SEQ ID NO: 2498 - protein, 99 aa, Emericella nidulans
KNIITIYGLINEPYMLSLDVEKVLNWTVTAAELVQKNGITAKIAFHDGFLNLSKWKTMLKNGPSNLLLDTHQYTIYNVAQIVLNHTAKVNFVCNDWVGM

SEQ ID NO: 2499 - protein, 92 aa, Emericella nidulans
EPYMLSLDVEKVLNWTVTAAELVQKNGITAKIAFHDGFLNLSKWKTMLKNGPSNLLLDTHQYTIYNVAQIVLNHTAKVNFVCNDWVGMIGEI

SEQ ID NO: 2500 - protein, 304 aa, Xenopus tropicalis
MEISTDSNMLVALAVIGVTVLLFLIKALGSQAKKAPLTLLDPNAKYPLPLIEKQEISHDTKKFRFGLPSQEHVLGLPVGQHVYLSAKINGSLVVRAYTPVSSDEVKGHVDLIVKVYYKNVHPKFPEGGKMSQHLDSLKIGETIDFRGPNGLLVYKEKGKFAIRPDKKSEPKLKVAKHVGMLAGGTGITPMLQLIRQITQDPNDNTKCSLIFANQTEDDILLRYELETVAKSHPEQFKLWYTLDRPPQGWKYGAGFVTADMIKEHLPPPSEDVVVLMCGPPPMIQFACQDNLTKLGYPEAGRFAY

SEQ ID NO: 2501 - protein, 169 aa, Danio rerio
MVRFKSRYLLCELCVSEPSSLHLFEDKVVYQALRGAVNRAHGDYGAAIFNITLGVLVKYLNAHTGVVLIRCRKAHYRLVWSSLPFITFLENRGQKVRCFFNCIHVGGTIRTSQKFLIKYNRQQLQRMLLDCKTDAEKQDVRKAILSCSLNLIKGEETDGSDDDGDEEDT

SEQ ID NO: 2502 - protein, 83 aa, Rattus norvegicus
NVKLTEILELLVAAGYFRARIKGLSPFDKVVGGMTWCITTCSFDVDVDLLFQENSTIGQKIALSEKIVSVLPRMKCPHQLEPH

SEQ ID NO: 2503 - protein, 285 aa, Rattus norvegicus
MFLLTPVLVAVVCILVIWVFKNADRSLEEKKEEARAQPWVDEDLKDNTEHLQVEEDTEEWQESEESVEHILFSHTRYPEQEMRMRSQEFYELLSKRRSIRFISSEPVPMEVIDNVIKAAGTAPSGAHTEPWTFVVVKDPDMKHKIREIIEEEEEINYMKRMGKRWVTDLKKLRTNWIKEYLDTAPVLILIFKQVHGFAVNGKKKVHYYNEISVSIACGILLAALQNAGLVTVTTTPLNCGPRLRVLLGRPSHEKLLVLLPVGYPSRGATVPDLKRKTLDQIMVTV

SEQ ID NO: 2504 - protein, 157 aa, Rattus norvegicus
MEVIDNVIKAAGTAPSGAHTEPWTFVVVKDPDMKHKIREIIEEEEEINYMKRMGKRWVTDLKKLRTNWIKEYLDTAPVLILIFKQVHGFAVNGKKKVHYYNEISVSIACGILLAALQNAGLVTVTTTPLNCGPRLRVLLGRPSHEKLLVLLPVGYPS

SEQ ID NO: 2505 - protein, 82 aa, Rattus norvegicus
MKRMGKRWVTDLKKLRTNWIKEYLDTAPVLILIFKQVHGFAVNGKKKVHYYNEISVSIACGILLAALQNAGLVTVTTTPLNC

SEQ ID NO: 2506 - protein, 285 aa, Rattus norvegicus
MAATRLWHRTGRLLEIASAFGPWPGVYSTSPAFAEVLRMPQKQLRKVVYPLRELEQHLVTDSRPGLIEQRLFDPSLEDIGRAESVFAATVRNRIEYLSSAVRLDHAPSLRQPEVCFIGRSNVGKSSLIKALFSMAPDVEVRISKKPGHTKKMNFFKVGKHFTLVDMPGYGYRAPEDFVDMVETYLKERNNLKRTFLLVDSVVGITKLDNIAIEMCEEFALPYVMILTKIDKSSKGYLLKQVLQIQEFVNTQTQGCFPQLFPISAVTYSGVHLLKCFIADITGSLK

SEQ ID NO: 2507 - protein, 52 aa, Rattus norvegicus
KEFPDVLTTANGTTKIKHGHVTGITVNKPRDGMSWPVAVATLLFFCILLFGL

SEQ ID NO: 2508 - protein, 42 aa, Rattus norvegicus
KIKHGHVTGITVNKPRDGMSWPVAVATLLFFCILLFGLGVRK

SEQ ID NO: 2509 - protein, 318 aa, Danio rerio
MGMSDIMWLDVSWAWLVLTAVLLAAAVFYLYTLILSHLAKTTVRNKVVLITDSLSTVGNECAKLFHAGGARLILCGSNWEKLEALAEQLTSQSDPTLTFPPKLVELDFSDMESVPEVISEILECFCCLDVLVFNSSMKLKAPVHSLSLQMDRLLMDVNYFGPITLVKGFLPSLISRRSGHILLVNSIQGKLAMPFRTTYAASKHAVQAFFECLRAEVQEYGITVSTINHTFIKTSSSIPKDEITARSMKTDHRQTPLGVSPKDVATELLRTLSSKKKEILMARWVPKAALYVRSLFPNLFFAIMAARVSNTVAETPDD

SEQ ID NO: 2510 - protein, 394 aa, Xenopus tropicalis
MDSQGRKVVVCDNGTGFVKCGYAGSNFPEHIFPALVGRPVIRSTAKVGNIEIKDLMVGDEASELRSMLEVNYPMENGIVRNWDDMKHLWDYTFGPEKLNIDTRDCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRVIKVGGERFEAPEALFQPHLINVEGVGVAELLFNTIQAADIDTRPEFYKHIVLSGGSTMYPGLPSRLERELKQLYLERVLKGDVEKLSKFKIRIEDPPRRKHMVFLGGAVLADIMKDKDNFWMTRQEYQEKGTRVLEKLGVTVR

SEQ ID NO: 2511 - protein, 124 aa, Chlorocebus aethiops
PEALKILSAITQPVVVVAIVGLYRTGKSYLMNKLAGKKKGFSLGSTVQSHTKGIWMWCVPHPKKPGHVLVLLDTEGLGDVEKGDNQNDSWIFALAILLSSTFVYNSMGTINQQAMDQLHYVTEL

SEQ ID NO: 2512 - protein, 125 aa, Chlorocebus aethiops
LKILSAITQPVVVVAIVGLYRTGKSYLMNKLAGKKKGFSLGSTVQSHTKGIWMWCVPHPKKPGHVLVLLDTEGLGDVEKGDNQNDSWIFALAILLSSTFVYNSMGTINQQAMDQLHYVTELTHRI

SEQ ID NO: 2513 - protein, 96 aa, Trichosurus vulpecula
IWCLVIFLVEVGASLVGLWVLKETSLKDKANTTNNTYAVIITNTSKYYLFYIYVGVADTFFALGLLRGLPLVHTLISVSKILHHKMLCSVLKAPMS

SEQ ID NO: 2514 - protein, 93 aa, Trichosurus vulpecula
CLVIFLVEVGASLVGLWVLKETSLKDKANTTNNTYAVIITNTSKYYLFYIYVGVADTFFALGLLRGLPLVHTLISVSKILHHKMLCSVLKAPM

SEQ ID NO: 2515 - protein, 384 aa, Schistosoma japonicum
MSIAVFIDGTDAQQVTELKKFLKSYGAKVLDNTECSDANWPDELIKCIKFLNVCWKDESIAESDAKDVLTSVASMFIQLPPNKLIEAVPLFCEKLLDFSGDNIRRHKNKLFPLNLLFWGLNPKSHPRYEIFLTLIECAEKMGVLNEVITDPKKVASWLSECDCTVEECQKVWQKLYDAHIALGENRKAIEAMIYLLSTYNEVTAVNARQNAIKCIISVLQDPCLLSHDQLYALKPVQYLEGEPVHDFFKIFVSGDLNTFKNFLAKHPNFLSHNNLSEEACVHKLRLLTLMQLSENVNELSYHEAATQLGLKIEELEPFIIEAVRQRAVACKLDQVQKKILITGAFPRTFGRPQWINLHDTLVQWRSHLGTVQSSLSMMIQNESS

SEQ ID NO: 2516 - protein, 975 aa, Mus musculus
MERYLPVSKKRNSSSSLEKITGSANGNGTLYSEEDTNLEENDFSWGDYLEETGTRAVPHVSFRHVEISIRSNFQPGMKLEVANKNNPDTYWVATIITTCGQLLLLRYCGYGEDRRADFWCDVIIADLHPVGWCTQNNKVLRPPDAIKDKYSDWTDFLIRELTGSRTAPANLLEGPLRGKGPIDLITVDSLIELQDSQNPFQYWIVSVTENVGGRLRLRYVGLEHTESYDRWLFYLDYRLRPIGWCQENKYRMDPPSDLYYLKLPFEWKCALEKALVLAAESPLPMEVFKDHADLQSHFFTVGMRLETLHISDPFHIYPASVTKVFNSKFFQVAIDDLRPEADKPTMLCHADSLGILPVQWCLKNGVNLAPPKGYSGQDFNWVDYHKQRQAEEAPHFCFKNAFSRGFSKNMKLEAVNPVNPGEVCVATVVSVKGRLLWLHLEGLETPMPDIIVDMDSMDIFPVGWCEANSYPLTTPYKASSKSKRKTVHFKMEKQLLSPVPIEKIPHELCLLPPQMDSPVGAINAKYCCPQLFVNHRCFSGPFLNKGRISELPQSVGPGMCVLVLKEILTLITNAAYKPGRVLRELQLVEDPEWNSQEEILKAKYGGKTYRAVVKIVRTADQVMNFCRQVCAKLECCPNLLSPVLISETCPENCSVHTKTRYNKREKGSSLSPASELKDDSASHATKLQKAKIPQTYYYGKRRRVIQSSLRVSNIETPPKSTRRRKRRKSVYVQKRRKSAIVVPAGVPAGVPAGVPEDIPAGIPEGIPASIPESIPEGIPESLPESLPEAIPESIPKGSAQKTEQEKRETLDTARKKTGYHGPAYQTDTSAAQVPFARPRRAVTLRRNSEALKRPPVERARRVRTVPTTASSNNRVKGPLVRIVKPEDSSQSDEEKLILESNPLEWSVTDVVRFIKLTDCAPLARIFQEQDIDGQALLLLTLPTVQECMELKLGPAIKLCHQIERVKVAFYAQYAS

SEQ ID NO: 2517 - protein, 334 aa, Bos taurus
MATLKEKLIAPVAEEETRIPNNKITVVGVGQVGMACAISILGKSLTDELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDEEVAQLKKSADTLWGIQKDLKDL

SEQ ID NO: 2518 - protein, 306 aa, Bos taurus
MAGVGLAAVPAWVPCRRWGLAAVTFGFHHGLSTLLARKTERAPQWLRACRHKTSISFLSRPDLPNLAYKRLKGKSPGIIFIPGYISNMNGTKALAIEEFCKSLGHAYIRFDYSGVGNSDGNLEECTVGKWRKDVLSIIDDLAEGPQILVGSSLGGWLMFHAAIARPQKVVALVGVATAVDGLVTQFNQLPIETKKEIEMKGVWPMPSKYSEEGVYRIQYSVIKEAEHHCLLHSPIPVKCPVRLLHGMKDDIVPWHTSVQVADRVVSTDVDVILRKNSDHRMKEKADIQLLVYTIDDLIDKLSTIVH

SEQ ID NO: 2519 - protein, 258 aa, Bos taurus
MDLSAEFKRWKAQCLSKADLSRKGSVDEDVLEIVQLLNGQEQFFTTSSCAGRIILLDRSVNGSEVQKQNCCWLLVTHKACVKDDVIVALQKAKGDAILKFEPLVLHVQCRQLQDAQILHSVAIDSGFRNSGITVGKRGKTMLAVRSTHGLEVPLSHQGKLMVTEEYINFLLKIANQKMEENKKRIERFYHCLQHALEKETVSTTSQPKEKVNTSYIRKKKRNPGKARGKRVNEEHDKELENNDHDDPGISDTIFPEDY

SEQ ID NO: 2520 - protein, 84 aa, Bos taurus
CPFTVTFYGALFREGDVWICMELMDTSLDKFYKQVIDKGQTIPEDILGKIAVSIVKALEHLHSKLSVIHRDVKPSNVLINALGQ

SEQ ID NO: 2521 - protein, 97 aa, Bos taurus
KRLLMDLDISMRTVDCPFTVTFYGALFREGDVWICMELMDTSLDKFYKQVIDKGQTIPEDILGKIAVSIVKALEHLHSKLSVIHRDVKPSNVLINAL

SEQ ID NO: 2522 - protein, 349 aa, Bos taurus
MTGKKVCIVGSGNWGSAIAKIVGGNAAQLAHFDPRVTMWVFEEDIGGRKLTEIINTQHENVKYLPGHKLPPNVVAVPDVVQAAADADILIFVVPHQFIGKICDQLKGHLKADTIGVSLIKGVDEGPKGLKLISEVIGERLGIPMSVLMGANIANEVADEKFCETTIGSKNQAHGQLLKELMQTPNFRITVVQEVDTVEICGALKNIVAVGAGFCDGLGFGDNTKAAVIRLGLMEMIAFAKLFCSGSVSSATFLESCGVADLITTCYGGRNRKVAEAFARTGKSIEQLEKEMLNGQKLQGPQTARELHSILQHKGMVDKFPLFTAVYKVCYENQPVGEFIHCLQNHPEHV

SEQ ID NO: 2523 - protein, 342 aa, Mus musculus
MEEQVLPELDVAELELQAVIGFNGHVPNGLKCHPDQEHLIYPLGCTVLIQAINTNEQNFLHGHGNNVSCVTISKEGDYIASGQVTFMGFKADIILWDFKKRELIARLSLHKGKIEALAFSPNDLYLVSLGGPDDGSVVVWSIAKRDAICGSPAAGLNVGNATSVVFSRCRDEMFVTAGNGTIRVWELDLPNRKIWPTECQTGQMKRIVLSTGMADDDSFFYLGTTTGDILKMNPKTKLLADTGPVKDKFSLGVSALRCLKMGGLLVGSGAGLLIFCKSPSYKPIKKVQLQGGITSITLRGEGHQFFVGTEESHIYRVNFTDFKETLIATCHFEAVQDIVFPL

SEQ ID NO: 2524 - protein, 500 aa, Mus musculus
MAKFVIAGKANCPYYAKAELLADYLQKNLPDFRIFKITQHPDKWEDWVEDVCERNMWDHRTSPIIWRELLDRGGRGLLLGGYNEFLEHAQLYYGVTSNMTTELMMVIAKENMQTHTEQQLDKETMKDLISPLQVWIASAGTYVCCHLIPLLLSGEVFGMHTEISLTLFDQEQREDCLRSIVMETQDLASPVLRTVSFCTTVKEAFLQAQVIIILDDSTEEEVYSLESCLRSRVPLCRLYGYLIEKNAHKSVKVIVGGKNFVNLKTTLLMQYAPNIASNIIAVALGVEGQAKAVLARKMKTTSANIKDVIIWGNITGNNYVDLRKAKVYNYESAVKGPPGHYHSVLSLIFDREWITKEFVQTLKILSSTGKQFGGILAAHSIATTLKYWYHGSPPGEIVSLGVMSEGQFDIPEGIVFSMPVKFENGTWVVLTDLEDISLSEKTLSRLTGDLIQEKLVACGDLLTFQPIEEDPKDNEPSNTGMNEEKEQPGSDDSDEKNEDQ

SEQ ID NO: 2525 - protein, 127 aa, Gallus gallus
KGHVKLAKFGLYHMTAQGVDVDFPIGYPSYLAPEVIAQGMVKPSDHTQCEKPLPSGPKSDLWSLGIILFELCVGRKLFQTLEIAERLKFVITLGYVDDIVTVLAEEHGCLDIIKDLSENVITLLKKC

SEQ ID NO: 2526 - protein, 127 aa, Gallus gallus
HVKLAKFGLYHMTAQGVDVDFPIGYPSYLAPEVIAQGMVKPSDHTQCEKPLPSGPKSDLWSLGIILFELCVGRKLFQTLEIAERLKFVITLGYVDDIVTVLAEEHGCLDIIKDLSENVITLLKKCLT

SEQ ID NO: 2527 - protein, 955 aa, Gallus gallus
MITSAAGIISLLDEEEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENAELPEGEKKPVDERLEGIVNKMFQRCLDDHKYKQAIGIALETRRLDIFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDAMEAEEKPGSTCVGKSAEINPEPKDQISKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVSQFRQLYSKVINDKHDDVMAKFGAILAQGILDAGGHNVIISLQSRTGHTHMPSVVGVLVFTQFWFWFPLSHFLSLAFTPTCVIGLNKDLKMPKVQYKSNCKPSTFAYPPPLEVPKEKEKEKVSTAVLSITAKAKKKEKEKEKEKKEEEKMEVDETEKKDEKEKKKEPEPNFQLLDNPARVMPAQLKVLTMTESCRYQPFKPLSIGGIIILKDTSEDMEELVEPVAAHGPKIEEEEQEPEPPEPFEYIDD

SEQ ID NO: 2528 - protein, 65 aa, Gallus gallus
GDPESDWIFLRVTARHVIEVELKAARVLHKLELKCLQKIETSEMTWKRMDLERVFPVLTLHFTYI

SEQ ID NO: 2529 - protein, 60 aa, Gallus gallus
IFLRVTARHVIEVELKAARVLHKLELKCLQKIETSEMTWKRMDLERVFPVLTLHFTYIRK

SEQ ID NO: 2530 - protein, 235 aa, Lactobacillus acidophilus
MDRPVIVALDLDNEEQLNKILSKLGDPHDVFVKVGMELFYNAGIDVIKKLTQQGYKIFLDLKMHDIPNTVYNGAKALAKLGITFTTVHALGGSQMIKSAKDGLIAGTPAGHSVPKLLAVTELTSISDDVLRNEQNCRLPMAEQVLSLAKMAKHSGADGVICSPLEVKKLHENIGDDFLYVTPGIRPAGNAKDDQSRVATPKMAKEWGSSAIVVGRPITLASDPKAAYEAIKKEFN

SEQ ID NO: 2531 - protein, 508 aa, Xenopus tropicalis
MAAIGVHLGCTCACVAVYKDGRADVVANDAGDRVTPAVVGFLEKETIVGLAAKQSRVRNATNTIVKVKQILGRSYGDPHTQKHISESKCIVVEKVGKPKYEIDTGETQKFVSSEDVAKLIFSKMKETAQSALGSDVNDVVITVPFDFGESQKKALGEAATAAGFSILRMIHEPSAALLAYGIGQESPTGKSNVLVYKLGGTSLSVTVIEVNSGIYRVLATSTYDDIGGICFTEALAQHLASEFQRTYKQDIRGNARAMMKLMNSADVAKHALSTLGSSNCFVDSLYDGIDFDCNVSRARFELICSSLFNQCIDPIKKLLEQIGFKANDVNQVVLCGGSARIPKLQQLIKDLFPEVEMLSSIPPDEVIPVGAAIQAGILIGKENLSTDLDTITIECSASDILVKETDESGDNKFTVLLPSGTPLPARRQHVLQAPGHISSVCLELYESGGKSPVESKFAQIVLKDLQKKASGVHDILTVLTMKRDGSLHITCTDKDSGKSEMITVEETP

SEQ ID NO: 2532 - protein, 399 aa, Xenopus laevis
MAHITINQYLQQVQEAIDSKDGFNCADLVSFKHPHVANARLQLLSPEEKCQQVLEPPYDEMFAAHLRCINAASNHDFVEAYKYQTLVVQSFLKSFQAHKEENWALPIMYSITLDLRIFANNADQQLVKKGKGKVGDMLEKAAEILMSCFRVCASDTRAAFEDSKKWGMLFLVNQLFKIYFKISKLHLCKPLIRAIDSSNFKEEYTMAQRVTFKYYVGRKSMFDSDFKKAEEYLSFAFEHCHRSSQKNKRMILIYLLPVKMLLGHMPTIHLLKKYDLMQFAEVTKAVSEGNLLLLTEALTKHETFFIRCGIFLILEKLKIISYRNLFKKVYLLLKTHQLSLDAFLVALKFMEVGDVDIDEVQCIIANLIYMGHIKGYISHQHQKLVVSKQNPFPPLSTVC

SEQ ID NO: 2533 - protein, 212 aa, Rattus norvegicus
MKVTLVHLLFMMLLLLLGLGVGLGLGLHMAAAILENQPLDEFWPSDSQDTAEATEEGQGTRTTEALVLDNKEMAVPVWSEDTVLSEDEVGGSRMLRAKTLLQSKQGYLKFDLNIRDCNVMMAHKIKEHNQSCINDYTFIHEDPSTVGAVCNSPLVDCDLKGGKCHKSPRPFDLTLCKLAKPGQVTPNCHYLTYITEKVIIITCNNTKQLEIK

SEQ ID NO: 2534 - protein, 548 aa, Zea mays
MAAPTLTADGPRLGQQEMKKMSPSFHPTLWGDFFLSYEAPTEAQEAQMREKAAVLKEEVRNMIKGSHDVPEIVDLIITLQRLNLDYHYEDEINEKLTVVYKSNYDGGNLDLVSRRFYLLRKCGYDVSSDVFLKFKDQLGNFVEADTRSLLSLYNAAFLRIHGETVLDEAISFTMRVLQDRLEHLESPLAEEVSSALDTPLFRRVGTLEMKDYIPIYEKDAKQNKSILEFAKLNFNLLQLRYSSELKECTTWWKELRVESNLSFVRDRIVEVYFWMSGGCYDPQYSHSRIILTKIVAFITILDDTLDSHATSCESMQLAEAIERWDESAVSLLPEYMKDFYMYLLKTFSSFENELGPDKSYRVFYLKEAVKELVREYTKEIKWRDEDYVPKTLKEHLKVSLISIGGTLVLCSAFVGMGDVVTKKIMKWVMSDAELVKSFGIFVRLSNDIVSTKREQREKHCVSTVQCYMKQHEITMDEACEQIKELTEDSWKFMIEQGLALKEYPIIVPRTVLEFARTVDYMYKEADKYTVSHTIKDMLTSLYVKPVLM

SEQ ID NO: 2535 - protein, 107 aa, Bos taurus
VQEAIAEVAGELNPDGSAQQQSKAVNKVKKKARKILQEMVATVSPAMIRLTGWVLLKLFNSFFWNIQIHKGQLEMVKAATETNLPLIFLPVHRSHIDYLLLTFILFC

SEQ ID NO: 2536 - protein, 65 aa, Bos taurus
VKKKARKILQEMVATVSPAMIRLTGWVLLKLFNSFFWNIQIHKGQLEMVKAATETNLPLIFLPVH

SEQ ID NO: 2537 - protein, 3166 aa, Mus musculus
MVFESVVVEVLNRFLGDYVVNLDESQLSLGIWKGAVALKNLVIKENALHELDVPFKVKVGHIGSLKLKIPWKNLYTQPVEAVLEEIFLLIVPSSRIQYDPIKEEKQLMETKQQELKRIEKAKQKVFDKEKPREEKQDTFTEKLVTQIIQNLQVQISSIHIRYEDDITNGDKPLSFGISLQNISLQTTDQYWIPCLHDNTEKLVRKLIRLDNLFAYWNVNSEMFYLNDYDESLKALKNGIVNENIVPEGYDFVFRPISASAKLQMNRRSDFDFSDPKINLAVDLHTIAIEFNKPQYFSLMELLESIDMMTQNQPYRKFKPSVPLHLHAKEWWAYAIHSILEVNVCPSLRMWSWEHIRNHRYKMKRYREFYKKKLTSKKPSPEILMSLEELEKTLDVFNITIARQQAEVEAKKAGYKIYKEGVKDPEDNAGWFGWLWTWSESNANQQQDVKPGILEEMLTPEEKSLLYEAIGYSETAVDPTLPKTFEALKFFVHLKSMSIVLRENHQKPELLNVVVEGLSTSVVQRPGAQAIKFETKIDSFHITGLPDDFKKPHLLSSLDDTSLLQITFEINPLNETVAQRCTIEAEPLEIIYDARTVNSIVEFFRPPKDVHLAQLTSVTLTKLEEFRAKTATGLLYVIETQKVLDLRINVKASYVIVPQYGNFSPTSNLLLLDLGHLKVSSKRRSLLPDVRPSEASLEDIMHRAYDSFDIQLTSIQLLYSRVGDNWKEARKLNVSTQHILIPMHVNVELSKAMVFMDIKMPKFKISGKLPLVSLRISDKKLQGIMELLGSIPKPEPVTDVSAPARSFQIQASALPVSHISQKLIPLLEQPVTEDDSEEEFFDAPCSPLEECPQVSCRDKCTRQKKLQKKDCVMNLIQLRMRFEVAEVSIQFYHLVGDCELPVLEMGALGLGTEAEFRTFDLKGSAFLKELWLKCPEYLDENKKPVYLITTLDNTMEDLLTLEFMKVEKNAPNLNSTYNNVLQLIKVNFSSLDIHLHTEALLNTMNYLNNILPELREKSASVSAAEPEDKGDIIKKLALKLPTNEDIITLQLLAELSCLQIFIQDQKQNISEIKIEGLDSEMIMKPLVTEINAKLRNIIVLDSDKMAIYKKALYITGKEVFSFKMISYMDATAGYAYTDMSVVDIRVHLTVGCIEVVFITKFLYSILAFIDNFQAVKDALAEATVQAAEMAADGVKELARKSSRFALDVNIKAPVVLIPQSPVSQNVFVADFGLITMKNIFVTVTETQSNIPPVIDLITIKLSKMRLYRSQFRNDTYQEVLDLLLPLNLEVIVERNLSWEWYKEVPCFNIKAQLKPMEFILSQEDLTTVFQTLHGNIWYGQDLSAPSSANKDPETMTSGVTSPPDHSPATVVTAAVVEVHPQASQAHTMLNVSFQTDYLTMALYSPGPDEASFTDVRDPSLELAEFKLENIISSLKIYTDDSTVFSFSVKNCILDDKRSHVMKATPRMIGLTVGFDKKDMVDIKYRKIKTFVVTDAVVQEMYVCASVEFLMTVAHIFFDAYMTSTALETSVQTRTTREAPAQELGKWEMNILIKNPEIVFVADMTRNDAPALVITTQCEICCKGEPTSNTVTAAIKDLQVRACPFLPVKRKGKVTTVLQPCDLFYQATQLGRDPQMIDISVKSLTLKVSPVIINTIITITSALYTTKETVPEENTSNIAHLWDKKDTKNLKMWFLEESNESEKVVPTNEVMPGGETLNLRIDSIFIVLEAGIGHRTVPMLLAKACFSGESKNWLSLINLHCHLELEVHYYNEMFGVWEPLLEPLEIDQTDDFRPWNLGIKMKKKAKEAIVESDSEAENYKVPEYKTAISFYSRDQLNITLSKCGLVMLNNLVEAFTEAATGSSSVFLRDLAPFMIFNSLGLTVSVSPSDSFSVLNVPLAKSYELKNDESLSMDYVRTKDNDHFNAMTSLSSKLFFILLTPANHSVADKIPLTKVGRRLYTVRHRESGVERSIICQIDTVEGSKKVTIRSPVQIKNHFSIPISVFEGDTLLGIASPENEFNIPLASYRSSLSLVPEDQDYQLCEGIDFEEIIKYDGQLLKKKCRSTNPSKKSFVINIVPEKDNLASLSVYSEDGWDLPYVLHLWPPILIRNLLPYKVAYYIEGIENTVVTLSEGHSSQIYNVEMDQAKLHLKLLDYLNHDWKSEFYIRSSQQDINFINFTCLTEMEKSDLDIAIHMTYNTGQTVVAFHSPYWMVNKTNRMLQYKADGIHRKHPPNYTKPVLFSFQPNHFFNNNKVQLMVTDSELSDQFSIDTVGSHGAIRCKGLKMEYQVGVTINLSSFNITRIVTFIPFYMIKNKSKYHISVAEEGSDKWLSLDLEQSIPFWPENASNILLIQVERSEDPPKRIYFNKQDNCILLRLNNELGGIIAEVNLAEHSTVITFSDYHDGAATFLLINHTKSDPVQYNQSSLGEIEDSLPPGKAVYYTWADPVGSRKLKWSCGQSYGEVTHKDDMMTPISVGKKTIYLVSFFEGLQRIILFTEDPRVFKVTYESEKAELAELEVVLALQDVGISLVNNYTKQEVAYIGITSSDVVWEAKPKKKARWKPMSVKHTEKLEKEFREYTEASPLEDKVVELDNIPVRLTPSGNDMKILQPHVIPVRRNYLPALKVEYNTSAHQSSFRIQIYRIQIQNQIHGAIFPFVFYPIKPPRSVTMDSAPKPFTDVSIVMRSAGHSQISRIKYFKVLIQEMDLSLDLGFVYALADLVTKAEVTEKTEVEHFHKDVEAFEQEYEVVSSVDQSQVNLFEYFHISPIKLHLSVSLSSGRDEAKDSEQHGGLIPVHSLNLLLKSIGATLTDVQDVVFKLAFFELNYQFHTTSELQSEVIRHYSKQAIKQMYVLILGLDVLGNPFGLIREFSEGVEAFFYEPYQGAIQGPEEFVEGMALGLKALVGGAVGGLAGAASKITSAMAKGVAAMTMDEDYQQKRREAMNKQPAGLREGITRGGKGLVSGFVSGITGIVTKPIKGAQKEGAAGFFKGVGKGLVGAVTRPTGGIIDMASSTFQGIKRATETSEVESLRPPRFFNEDGVIRPYRLRDGSGNQMLQVMENGRFAKYKYFTHVMINKTDMFMITRRGVLFVTKGTFGQLTCEWQYTFDEFTKEPFIVHGRRLRIEAKERVKSVFHAKEFGKIVNFKTPEDARWILTKLEEAREPSPRL

SEQ ID NO: 2538 - protein, 3061 aa, Mus musculus
MVFESVVVEVLNRFLGDYVVNLDESQLSLGIWKGAVALKNLVIKENALHELDVPFKVKVGHIGSLKLKIPWKNLYTQPVEAVLEEIFLLIVPSSRIQYDPIKEEKQLMETKQQELKRIEKAKQKVFDKEKPREEKQDTFTEKLVTQIIQNLQVQISSIHIRYEDDITNGDKPLSFGISLQNISLQTTDQYWIPCLHDNTEKLVRKLIRLDNLFAYWNVNSEMFYLNDYDESLKALKNGIVNENIVPEGYDFVFRPISASAKLQMNRRSDFDFSDPKINLAVDLHTIAIEFNKPQYFSLMELLESIDMMTQNQPYRKFKPSVPLHLHAKEWWAYAIHSILEVNVCPSLRMWSWEHIRNHRYKMKRYREFYKKKLTSKKPSPEILMSLEELEKTLDVFNITIARQQAEVEAKKAGYKIYKEGVKDPEDNAGWFGWLWTWSESNANQQQDVKPGILEEMLTPEEKSLLYEAIGYSETAVDPTLPKTFEALKFFVHLKSMSIVLRENHQKPELLNVVVEGLSTSVVQRPGAQAIKFETKIDSFHITGLPDDFKKPHLLSSLDDTSLLQITFEINPLNETVAQRCTIEAEPLEIIYDARTVNSIVEFFRPPKDVHLAQLTSVTLTKLEEFRAKTATGLLYVIETQKVLDLRINVKASYVIVPQYGNFSPTSNLLLLDLGHLKVSSKRRSLLPDVRPSEASLEDIMHRAYDSFDIQLTSIQLLYSRVGDNWKEARKLNVSTQHILIPMHVNVELSKAMVFMDIKMPKFKISGKLPLVSLRISDKKLQGIMELLGSIPKPEPVTDVSAPARSFQIQASALPVSHISQKLIPLLEQPVTEDDSEEEFFDAPCSPLEECPQVSCRDKCTRQKKLQKKDCVMNLIQLRMRFEVAEVSIQFYHLVGDCELPVLEMGALGLGTEAEFRTFDLKGSAFLKELWLKCPEYLDENKKPVYLITTLDNTMEDLLTLEFMKVEKNAPNLNSTYNNVLQLIKVNFSSLDIHLHTEALLNTMNYLNNILPELREKSASVSAAEPEDKGDIIKKLALKLPTNEDIITLQLLAELSCLQIFIQDQKQNISEIKIEGLDSEMIMKPLVTEINAKLRNIIVLDSDKMAIYKKALYITGKEVFSFKMISYMDATAGYAYTDMSVVDIRVHLTVGCIEVVFITKFLYSILAFIDNFQAVKDALAEATVQAAEMAADGVKELARKSSRFALDVNIKAPVVLIPQSPVSQNVFVADFGLITMKNIFVTVTETQSNIPPVIDLITIKLSKMRLYRSQFRNDTYQEVLDLLLPLNLEVIVERNLSWEWYKEVPCFNIKAQLKPMEFILSQEDLTTVFQTLHGNIWYGQDLSAPSSANKDPETMTSGVTSPPDHSPATVVTAAVVEVHPQASQAHTMLNVSFQTDYLTMALYSPGPDEASFTDVRDPSLELAEFKLENIISSLKIYTDDSTVFSFSVKNCILDDKRSHVMKATPRMIGLTVGFDKKDMVDIKYRKIKTFVVTDAVVQEMYVCASVEFLMTVAHIFFDAYMTSTALETSVQTRTTREAPAQELGKWEMNILIKNPEIVFVADMTRNDAPALVITTQCEICCKGEPTSNTVTAAIKDLQVRACPFLPVKRKGKVTTVLQPCDLFYQATQLGRDPQMIDISVKSLTLKVSPVIINTIITITSALYTTKETVPEENTSNIAHLWDKKDTKNLKMWFLEESNESEKVVPTNEVMPGGETLNLRIDSIFIVLEAGIGHRTVPMLLAKACFSGESKNWLSLINLHCHLELEVHYYNEMFGVWEPLLEPLEIDQTDDFRPWNLGIKMKKKAKEAIVESDSEAENYKVPEYKTAISFYSRDQLNITLSKCGLVMLNNLVEAFTEAATGSSSVFLRDLAPFMIFNSLGLTVSVSPSDSFSVLNVPLAKSYELKNDESLSMDYVRTKDNDHFNAMTSLSSKLFFILLTPANHSVADKIPLTKVGRRLYTVRHRESGVERSIICQIDTVEGSKKVTIRSPVQIKNHFSIPISVFEGDTLLGIASPENEFNIPLASYRSSLSLVPEDQDYQLCEGIDFEEIIKYDGQLLKKKCRSTNPSKKSFVINIVPEKDNLASLSVYSEDGWDLPYVLHLWPPILIRNLLPYKVAYYIEGIENTVVTLSEGHSSQIYNVEMDQAKLHLKLLDYLNHDWKSEFYIRSSQQDINFINFTCLTEMEKSDLDIAIHMTYNTGQTVVAFHSPYWMVNKTNRMLQYKADGIHRKHPPNYTKPVLFSFQPNHFFNNNKVQLMVTDSELSDQFSIDTVGSHGAIRCKGLKMEYQVGVTINLSSFNITRIVTFIPFYMIKNKSKYHISVAEEGSDKWLSLDLEQSIPFWPENASNILLIQVERSEDPPKRIYFNKQDNCILLRLNNELGGIIAEVNLAEHSTVITFSDYHDGAATFLLINHTKSDPVQYNQSSLGEIEDSLPPGKAVYYTWADPVGSRKLKWSCGQSYGEVTHKDDMMTPISVGKKTIYLVSFFEGLQRIILFTEDPRVFKVTYESEKAELAELEVVLALQDVGISLVNNYTKQEVAYIGITSSDVVWEAKPKKKARWKPMSVKHTEKLEKEFREYTEASPLEDKVVELDNIPVRLTPSGNDMKILQPHVIPVRRNYLPALKVEYNTSAHQSSFRIQIYRIQIQNQIHGAIFPFVFYPIKPPRSVTMDSAPKPFTDVSIVMRSAGHSQISRIKYFKVLIQEMDLSLDLGFVYALADLVTKAEVTEKTEVEHFHKDVEAFEQEYEVVSSVDQSQVNLFEYFHISPIKLHLSVSLSSGRDEAKDSEQHGGLIPVHSLNLLLKSIGATLTDVQDVVFKLAFFELNYQFHTTSELQSEVIRHYSKQAIKQMYVLILGLDVLGNPFGLIREFSEGVEAFFYEPYQGAIQGPEEFVEGMALGLKALVGGAVGGLAGAASKITSAMAKGVAAMTMDEDYQQKRREAMNKQPAGLREGITRGGKGLVSGFVSGITGIVTKPIKGAQKEGAAGFFKGVGKGLVGAVTRPTGGIIDMASSTFQGIKRATETSEVESLRPPRFFNEDGVIRPYRLRDGSGNQMLQASKSLI

SEQ ID NO: 2539 - protein, 319 aa, Staphylococcus aureus; identical to SEQ ID NO: 80

SEQ ID NO: 2540 - protein, 241 aa, Staphylococcus aureus
MSNEILIVDDEDRIRRLLKMYLERESFEIHEASNGQEAYELAMENNYACILLDLMLPEMDGIQVATKLREHKQTPIIMLTAKGEETNRVEGFESGADDYIVKPFSPREVVLRVKALLRRTQSTTVEQSEPHARDVIEFKHLEIDNDAHRVLADNQEVNLTPKEYELLIYLAKTPNKVFDREQLLKEVWHYEFYGDLRTVDTHVKRLREKLNRVSSEAAHMIQTVWGVGYKFEVKSNDEPAK

SEQ ID NO: 2541 - protein, 228 aa, Staphylococcus aureus; identical to SEQ ID NO: 2116

SEQ ID NO: 2542 - protein, 352 aa, Xenopus laevis
MERKPSVCRKSGSWNCLLVLFLLLLFTVVSVNFLLYMYIDQMYAPSRFSHSEVNLCPYGHFKIATIKNCSPWLTCETIKKEVRKLKLVGEGAVKKVFLSEWKGLKVALSELKSLDLQDDFLHGLRMLQSMQSRYVVVLVGYCKETFSILTEYHPLGSLKDLDETFSFPKYQGFNTWQNRLKLAIEYVSIINYLHNSPHGTLIMCDSNDLDKALSQYMLTSDFHVVANDLDALPVVDKEKGILVKCGQREITGHFVAPEQLWPYGPNIEFSDDLMPSYDEKTDIWKIPAVIDHLLGHVKGSDIVRFHLFDIHSECGKANPSERPSAQMVLDTYRKVLALLMKEMAVAETREML

SEQ ID NO: 2543 - protein, 338 aa, Rattus norvegicus
MALCVLQNAVRGAAALPRLKASLVASVCRPGYSSLSNHKYVPRRAVLYVPGNDEKKIRKIPSLKVDCAVLDCEDGVAENKKNEARLRIAKTLEDFDLGTTEKCVRINSVSSGLAEADLETFLQARVLPSSLMLPKVEGPEEIQWFSDKFSLHLKGRKLEQPMNLIPFVETAMGLLNFKAVCEETLKIGPQVGLFLDAVVFGGEDFRASIGATSNKDTQDILYARQKIVVTAKAFGLQAIDLVYIDFRDEDGLLRQSREAAAMGFTGKQVIHPNQIAVVQEQFTPTPEKIRWAEELIAAFKEHQQLGKGAFTFQGSMIDMPLLKQAQNIVTLATSIKEK

SEQ ID NO: 2544 - protein, 275 aa, Rattus norvegicus
MALCVLQNAVRGAAALPRLKASLVASVCRPGYSSLSNHKYVPRRAVLYVPGNDEKKIRKIPSLKVDCAVLDCEDGVAENKKFSDKFSLHLKGRKLEQPMNLIPFVETAMGLLNFKAVCEETLKIGPQVGLFLDAVVFGGEDFRASIGATSNKDTQDILYARQKIVVTAKAFGLQAIDLVYIDFRDEDGLLRQSREAAAMGFTGKQVIHPNQIAVVQEQFTPTPEKIRWAEELIAAFKEHQQLGKGAFTFQGSMIDMPLLKQAQNIVTLATSIKEK

SEQ ID NO: 2545 - protein, 165 aa, Rattus norvegicus
MKRAFVTVGTTSFDDLVARVVANDTVQILKSLGYNHLVLQIGRGTVVPEPFSTEPFTLDVYRYKESLKEDLQQADLVISHAGAGSCLESLEKGKPLVVVVNEKLMNNHQFELAKQLHKEGHLFYCTCSMLPGLLQSMDLSTLKCYPPGQPEKFSAFLDKVVGLQK

SEQ ID NO: 2546 - protein, 73 aa, Pan troglodytes
VAKEPSTKGLSPNLSHQMTKRKRMVLVKERKAAQTLSAILLAFIITWTPYNIMVLVSTFCDKCVPVALWHLGY

SEQ ID NO: 2547 - protein, 60 aa, Pan troglodytes
LSHQMTKRKRMVLVKERKAAQTLSAILLAFIITWTPYNIMVLVSTFCDKCVPVALWHLGY

SEQ ID NO: 2548 - protein, 381 aa, Pan troglodytes
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 2549 - protein, 169 aa, Pan troglodytes
EIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRK

SEQ ID NO: 2550 - protein, 51 aa, Pan troglodytes
KTTKMLVCVVVVFAVSWLPLHAFQLAVDIDSQVLDLKEYKLIFTVFHIIAM

SEQ ID NO: 2551 - protein, 458 aa, Pan troglodytes
MLPDFMLVLIVLGIPSSATTGFNSIAENEDALLRHLFQGYQKWVRPVLHSNDTIKVYFGLKISQLVDVDEKNQLMTTNVWLKQEWTDHKLRWNPDDYGGIHSIKVPSESLWLPDIVLFENADGRFEGSLMTKVIVKSNGTVVWTPPASYKSSCTMDVTFFPFDRQNCSMKFGSWTYDGTMVDLILINENVDRKDFFDNGEWEILNAKGMKGNRRDGVYSYPFITYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLEKKKQKQLSDGEKVLVAFLEKAADSIRYISRHVKKEHFISQVVQDWKFVAQVLDRIFLWLFLIVSVTGSVLIFTPALKMWLHSYH

SEQ ID NO: 2552 - protein, 106 aa, Pan troglodytes
TSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLE

SEQ ID NO: 2553 - protein, 43 aa, Pan troglodytes
TLSIIVTVFVINVHHRSSSTYHPMAPWVKRLFLQKLPKLLCMK

SEQ ID NO: 2554 - protein, 73 aa, Saimiri boliviensis; identical to SEQ ID NO: 2546

SEQ ID NO: 2555 - protein, 60 aa, Saimiri boliviensis; identical to SEQ ID NO: 2547

SEQ ID NO: 2556 - protein, 214 aa, Xenopus laevis
MAETSGPQSSHISSSSVGEKGSGCAVRDLLYWRDVKQSGMVFGGTMVLLLSLAAFSIISVISYLVLSLLTVTISYRVYKSVLQAVQKTDEGHPFKPLLEKDITLSSDSFQKALTASLAHVNHALKYIVRLFLVDDLVDSLKLALLMWLMTYVGAVFNGITLLILGVLLTFTAPIVYEKYKVQIDHYVSLVHSQVKSITEKIQAKLPGALKKKSE

SEQ ID NO: 2557 - protein, 820 aa, Bacteroides fragilis
MNISYNWLKEYVNFDLTPDEVAAALTSIGLETGGVEEVQTIKGGLEGLVIGEVLTCVEHPNSDHLHITTVNLGNGEPTQIVCGAPNVAAGQKVVVATLGTKLYDGDECFTIKKSKIRGVESIGMICAEDEIGIGTSHDGIIVLPEDAVPGTLAKDYYNVKSDYVLEVDITPNRADACSHYGVARDLYAYLVQNGKQAALTRPSVDAFAVENHDLDIKVTVENSEACPRYAGVTVKGVTVKESPEWLQNKLRIIGLRPINNVVDITNYIVHAFGQPLHCFDANKIKGGEVIVKTMPEGTTFVTLDGVERKLNERDLMICNKEDAMCIAGVFGGLDSGSTEATTDVFLESAYFHPTWVRKTARRHGLNTDASFRFERGIDPNITIYCLKLAAMMVKELAGGTISSEIKDVCAAPAQDFIVELTYEKVHSLIGKVIPVETIKSIVTSLEMKIMDETAEGLTLAVPPYRVDVQRDCDVIEDILRIYGYNNVEIPSTLKSSLTTKGDCDKSNKLQNLVAEQLVGCGFNEILNNSLTRAAYYDGLESYPSKNLVMLLNPLSADLNCMRQTLLFGGLESIAHNANRKNADLKFFEFGNCYHFDAEKKNPEKVLAPYSEDYHLGLWVTGKMVSNSWAHADENTSVYELKAYVENIFKRLGLDLHSLVVGNLSDDIYSTALTVNTKGGKRLATFGVVTKKMLKAFDVDNEVYYADLNWKELMKAIRSVKVSYKEISKFPAVKRDLALLLDKKVQFAEIEKIAYETEKKLLKEVSLFDVYEGKNLEAGKKSYAVSFLLQDESQTLNDKMIDKIMSKLVKNLEDKLGAKLR

SEQ ID NO: 2558 - protein, 145 aa, Xenopus tropicalis
EKMFQDKVEPLVRSSSAHLKAFTFTKVHLGEKFPRINGVKSYTKNVDKREVILDLQLSYNGDVEINVEVKKMCKAGVKGVQLHGTLRVILAPLLPDLPFVGAVTMFFIQRPHLDINWTGLTNVLEIPGVSDFSDSMIVDMIASHL

SEQ ID NO: 2559 - protein, 49 aa, Xenopus tropicalis
KKMCKAGVKGVQLHGTLRVILAPLLPDLPFVGAVTMFFIQRPHLDINWT

SEQ ID NO: 2560 - protein, 1077 aa, Xenopus tropicalis
MLRAVLQANKNGVPLSKLQAEYKSFTGEPIPFKDMGFHALDAYLKSIPSVVRIEVSRVGEVICYAVVCKETARIAALVAHQRSSKKKSGGQVNCQMRLKYTAPVSHFGKPKATLRQPGFTPPQEKIIRKPVPTSAWGKGNTFGSRTFEYSPPPIPQLFGIAPIQMHLPNINRPERKVTLPPRFQREVNSFLNPTPMTDSNANHTQSLKSVVPGSGQPRCDLSVIQNNLKELLNKHSNGLWLSKLPQLYKETYKQDLGGEMLKQVPSWTHICMVQKLVTMGHTEMVLYSTAIKQPSFTKNVQNHSNNQAKPNVPVDSTPSSPPLQSSGNIPKDELKQKISKVLTKYSNGLWYHALPKVFEDMFKQKLPTEVLNLDSLTDICTVDLISEEPFKAILYAKSAERANQNSNPSVNNNIPQKLQDRESPLLPEEPEMNMTPPPLVIPSEASPSVLVVELSSTNDVVIRYIGRDYSAAQEHMEDEMKDFCSKSSTAKIGFLRVGQLVAAKAEEDVWLRAQISAIEGKKVKVCYVDYGFSEIVDITKVCKLGKQFYTLPFQATKCRLAGLEAFCDDSIIIKALELKACGKILAVEILEKSEKPLVVLYDTSGDDDININAACLKELCDRSLSLQLKANSSFSNVIVTNVCSDGTLFCQLPSKGLAKLYETLQKVDSEFQSKQVTSHLYVSLPFCGKICLYHYKGKWARVEITSVHSSRALDVQFLDSGTIASVKVSELKEIPPPLLRDLISIPPQALRCCLADLPLRIGMWTPDAVLWLRNTVLNCLECSIRVVKVDEATNMVHIYLFTSNNFPDLERSINRQITNEELWKHQKDVFLNLSASTLESSRGGGAQASELSPPGLCKDHTSAVKKPDMQQSSSVPSFNMPPPLPLPRPGEHMDVFVSVACHPGHFVCQPWQELHKLEVVMEEMLLHYSTTEEKPVALEKNKLYAAKVENKWYRVLVKGILTNGLVSVYELDYGRHELVSCRKVQPLIEKFMQLPFQAITSQLAGVSCEHWSEEASIVFRNHVEKKPLVALVQTIHESTHPWDRRAVAYIVDTSLPDTDIWIHELMTEYHIQLSKPE

SEQ ID NO: 2561 - protein, 129 aa, Xenopus tropicalis
ACGKILAVEILEKSEKPLVVLYDTSGDDDININAACLKELCDRSLSLQLKANSSFSNVIVTNVCSDGTLFCQLPSKGLAKLYETLQKVDSEFQSKQVTSHLYVSLPFCGKICLYHYKGKWARVEITSVH

SEQ ID NO: 2562 - protein, 117 aa, Xenopus tropicalis
VIVTNVCSDGTLFCQLPSKGLAKLYETLQKVDSEFQSKQVTSHLYVSLPFCGKICLYHYKGKWARVEITSVHSSRALDVQFLDSGTIASVKVSELKEIPPPLLRDLISIPPQALRCC

SEQ ID NO: 2563 - protein, 394 aa, Rattus norvegicus
MDSQGRKVVVCDNGTGFVKCGYAGSNFPEHIFPALVGRPIIRSTTKVGNIEIKDLMVGDEASELRSMLEVNYPMENGIVRNWDDMKHLWDYTFGPEKLNIDTRSCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 2564 - protein, 186 aa, Danio rerio
MGLFDKLAGWLGLKKKEVNVLCLGLDNSGKTTIINQLKPSNAQAQDIVPTIGFSIEKFKTSSLSFTVFDMSGQGRYRNLWEHYYKEGQAIIFVIDSGDKLRMVVAKEELDTLLNHPDIKHRRIPLLFFANKMDLRDALSAVKVSQLLCLENIKDKPWHICASDAVKGEGLLEGVDWLQDQIRAMKT

SEQ ID NO: 2565 - protein, 29 aa, Oryza sativa
LTLNWVAFCIETSNKATVLKLHKEYVPIC

SEQ ID NO: 2566 - protein, 133 aa, Oryza sativa
VVLCLLGISERVADIKTRGHAMKCLTAFCEAVGPGFVFERLYKIMKEHKNPKVLSEGILWMVSAVEDFGISNLKLKDTIDFCKDIGLQSSAAATRNATIKLIGVLHKFVGPDIKGFLSDVKPALLSTLDAEYE

SEQ ID NO: 2567 - protein, 149 aa, Mus musculus
LIADALKAGAVPKAFFFSRLEYVKELPVDKLKDVSLIKVKFEDIKDWSDLVTPQGIMGIFAKPDPVKMTYPETPLHHTLPLVLICDNLRDPGNLGTILRSAAGAGCSKVLLTKGCVDAWEPKVLRAGMGAHFQVPIVNNVEWETVPNHL

SEQ ID NO: 2568 - protein, 66 aa, Mus musculus
LEYVKELPVDKLKDVSLIKVKFEDIKDWSDLVTPQGIMGIFAKPDPVKMTYPETPLHHTLPLVLIC

SEQ ID NO: 2569 - protein, 282 aa, Francisella tularensis
MILIDGKSLSKDLKERLATQVQEYKHHTAITPKLVAIIVGNDPASKTYVASKEKACAQVGIDSQVITLPEHTTESELLELIDQLNNDSSVHAILVQLPLPAHINKNNVIYSIKPEKDVDGFHPTNVGRLQLRDKKCLESCTPKGIMTMLREYGIKTEGAYAVVVGASNVVGKPVSQLLLNAKATVTTCHRFTTDLKSHTTKADILIVAVGKPNFITADMVKEGAVVIDVGINHVDGKIVGDVDFAAVKDKVAAITPVPGGVGPMTITELLYNTFQCAQELNR

SEQ ID NO: 2570 - protein, 600 aa, Pongo abelii
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVSCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSILKDHCVQHLPDGSVTVESILIQAAAPSEDPGTKVLLVSWTYQDEELGSFLTSLLKKGLPQAPS

SEQ ID NO: 2571 - protein, 300 aa, Pongo abelii
MKFLLDVLLLLPLLIVCSLESFVKLFIPKRRKSVTGEIVLITGAGHGIGRLTAYEFAKLKSKLVLWDINKHGLEETAAKCKGLGAKVHTFVVDCSNREDIYSAAKKVKAEIGDVSILVNNAGVVYTSDLFATQDPQIEKTFEVNVLAHFWTTKAFLPAMMKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYRMKAQ

SEQ ID NO: 2572 - protein, 160 aa, Pongo abelii
MKFLLDVLLLLPLLIVCSLESFVKLFIPKRRKSVTGEIVLITGAGHGIGRLTAYEFAKLKSKLVLWDINKHGLEETAAKCKGLGAKVHTFVVDCSNREDIYSAAKKVKAEIGDVSILVNNAGVVYTSDLFATQDPQIEKTFEVNVLAHFWTTKAFLPAMM

SEQ ID NO: 2573 - protein, 94 aa, Pongo abelii
MKFLLDVLLLLPLLIVCSLESFVKLFIPKRRKSVTGEIVLITGAGHGIGRLTAYEFAKLKSKLVLWDINKHGLEETAAKCKGLGAKVHTFVVDC

SEQ ID NO: 2574 - protein, 338 aa, Pongo abelii
MLSALARPASAVLRRSFSTSAQNNAKVAVLGASGGIGQPLSLLLKNSPLVSRLTLYDIAHTPGVAADLSHIETKATVKGYLGPEQLPDCLKGCDVVVIPAGVPRKPGMTRDDLFNTNATIVATLTSACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 2575 - protein, 364 aa, Pongo abelii
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIVMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 2576 - protein, 334 aa, Xenopus laevis
MAARKETGNTAPIAETAVKQVQIDGLVVLKIIKHYQEEGHGSEVVQGVLLGLVVDDRLEITNCFPFPQHTEDDVDFDEVQYQMEMMRSLRHVNIDHLHVGWYQSTFYGTFVSRALLDSQFSYQHAIEESVVLIYDPIKTSQGSLSLKAYRLTPKLMEICKEKDFSAEGLKKANVAYEDMFEEVPIVIKNSHLINVLVWELDKKAPVTEKHELLNLSSSNHLEKSLQLLMDRVDEMSQDIVKYNTYQRNVGKQQQQKHQYTQRKQQENLQRLSRGETPLPEEDVNKMFKPPVTPSRMDPLLIAGQINTYIQHIKGFTSQNLGKLFMAEALQDQTN

SEQ ID NO: 2577 - protein, 296 aa, Xenopus laevis
MLVALAAIGVTVLLFLIKALGSGAKKAPVTLLDPNAKYPLPLIEKQEISHDTKKFRFGLPSAEHVLGLPVGQHIYLSAKVNGSLVVRAYTPVSSDEVKGHVDLVVKVYYKNVNPKFPDGGKMSQHLDSLKIGETIDFRGPNGLLVYKGKGKFAIRPDKKAEPKIKVAKHVGMLAGGTGITPMLQLIRQITQDPNDNTKCYLIFANQTEDDILLRYELETVAKSHPEQFKLWYTLDRPPQGWKYGSGFVTADMIKEHLPPPSEDVLVLMCGPPPMIQFACQDNLTKLGYPEAGRFAY

SEQ ID NO: 2578 - protein, 112 aa, Oryza sativa
ELFMHISSAPTLAKYMARFALILSKTITWDADLSAVYVRRIKDEPCMDRHGNVVHKDQEPLIHTDGTGLVSVDLALNCPTSIFKGKFLKPQPLLMQFRLFYNGSAVKGTVLV

SEQ ID NO: 2579 - protein, 116 aa, Oryza sativa
KYMARFALILSKTITWDADLSAVYVRRIKDEPCMDRHGNVVHKDQEPLIHTDGTGLVSVDLALNCPTSIFKGKFLKPQPLLMQFRLFYNGSAVKGTVLVDRRLPPATILIRPSMVK

SEQ ID NO: 2580 - protein, 375 aa, Pan troglodytes
MSTAGKVIKCKAAVLWEVKKPFSIEDVEVAPPKAYEVRIKMVAVGICRTDDHVVSGNLVTPLPAILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 2581 - protein, 332 aa, Pan troglodytes
MATLKDQLIHNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 2582 - protein, 311 aa, Pongo abelii
MACAAVMIPGLLRCSVGAICTEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDSEVAVRVGGEFFFDPQPADASRNLVLIAGGVGINPLLSILRHAADLLREQANKRNGYEIGTIKLFYSAKSTSELLFKKNILDLVNEFPEKIACSSHVTKQTTQINAELKPYITGRITEKEIRDHISKETLFYICGPPPMTDFFSKQLENNHVPKEHICFEKWW

SEQ ID NO: 2583 - protein, 394 aa, Pongo abelii
MDSQGRKVVVCDNGTGFVKCGYAGSNFPEHIFPALVGRPIIRSTTKVGNIEIKDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEDFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 2584 - protein, 383 aa, Pongo abelii
MAAALRPSNRVLLQALQTLVYPGVGGSGSVSCRCPVGAKRYLLTDNVVKLKEFQQKKVAIACNLSGTKEMYFRNLKEKLTQNKLILKGELITLLHLCESRDHVELAKNVIYRYHAENKNFTLGEYKFGPLFMRLCYELNLEESAVELVKDQHLRGFFSDSTSFNILMDMLFIKGKYKSALEVLIEMKNQNVKFTTDTYVLAFAICYKLNSPESFKICTILGEKALLKGEILSRRASCFAVALALNQNEVAKAMSIFSQIMNPESIACVNLNIIIHIQSNMLENLIKTLNNAAEGNLSKFVKRNVFSEEVLAKVREKVKDVPALVAKFDEIYGILHITGQVTTDSLDAVLCHTPKDRKSHMLLLNKRMFSRRTSQPLSQSLLAE

SEQ ID NO: 2585 - protein, 109 aa, Pongo abelii
MQKKETNLCLSADVSEARELLQLADALGPSICMLKTHVDILNDFTLDVMKELITLAKRHEFLIFEDRKFADIGNTVKKQYEGGVFKIASWADLVNAHVVPGSGVVKGLQ

SEQ ID NO: 2586 - protein, 96 aa, Pongo abelii
MLKTHVDILNDFTLDVMKELITLAKRHEFLIFEDRKFADIGNTVKKQYEGGVFKIASWADLVNAHVVPGSGVVKGLQEVGLPLHRGCLLIAEMSST

SEQ ID NO: 2587 - protein, 592 aa, Pongo abelii
MAPGHLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMKSSEIKDTSLETRRQLALKAFTHTAQYDEAISDYFRKQYSKGISQMPLRYGMNPHQTPAQLYTLKPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALKILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWEALFEEVPELLTEAEKKEWVEKLTEVSISSDAFFPFRDNVDRAKRSGVAYIAAPSGSAADKVVIEACDELGIILAHTNLRLFHH

SEQ ID NO: 2588 - protein, 332 aa, Pongo abelii
MATLKDQLIHNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPSSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 2589 - protein, 357 aa, Pongo abelii
MAAAAKPSNLSLVVHGPGDLRLENYPIPEPGPNEVLLRMHSVGICGSDVHYWEDGRIGNFIVKKPMVLGHEASGTVEKVGSLVKHLKPGDRVAIEPGAPRENDEFCKIGRYNLSPSIFFCATPPDDGNLCRFYKHNAAFCYKLPDNVTFEEGAMIEPLSVGIHACRRGGVTLGHKVLVCGAGPIGMVTLLVAKAMGAAQVVVTDLSATRLSKAKEIGADLVLQISKESPQEIARKVEGLLGCKPEVTIECTGAGASIQAGIYATHSGGTLVLVGLGSEMTTIPLLHAAIREVDIKGVFRYCNTWPVAISMLASKSVNVKPLITHRFPLEKALEAFETFKKGLGLKIMLKCDPNDQNP

SEQ ID NO: 2590 - protein, 71 aa, Pongo abelii
LVLVGLGSEMTTIPLLHAAIREVDIKGVFRYCNTWPVAISMLASKSVNVKPLITHRFPLEKALEAFETFKK

SEQ ID NO: 2591 - protein, 85 aa, Pongo abelii
VLVGLGSEMTTIPLLHAAIREVDIKGVFRYCNTWPVAISMLASKSVNVKPLITHRFPLEKALEAFETFKKGLGLKIMLKCDPNDQ

SEQ ID NO: 2592 - protein, 918 aa, Pongo abelii
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVQQEKARMGSAGLRVLALASGPELGQLTFLGLVGIIDPPRTGVKEAVTTLIASGVSIKMITGDSQETAIAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNKMFCYAVLGSIMGQLLVIYFPPLQKVFQTESLSILDLLFLLGLTSSVCIVAEIIKKVERSREKIQKHVSSTSSSFLEV

SEQ ID NO: 2593 - protein, 843 aa, Pongo abelii
MAKPLTDSEKRKQISVRGLAGLGDVAEVRKSFNRHLHFTLVKDRNVATPRDYLFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVNDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGAEASGTGNMKFMLNGALTIGTMDGANVEMAEEAGAENLFIFGLQVEDVEALDRKGYNAREYYDHLPELKQAVDQISSGFFSPKEPNCFKDIVNMLMHHDRFKVFADYEAYMQCQAQVDQLYRNPKEWTKKVIRNIACSGKFSSDRTITEYAREIWGVEPSDLQIPPPNVPRD

SEQ ID NO: 2594 - protein, 953 aa, Pongo abelii
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTGSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 2595 - protein, 537 aa, Pongo abelii
MGDEDKRITYEDSEPSTGMNYTPSMHQETQEETVMKLKGIDANEPTEGSILLKSSEKKLQETPTEANHVQRLRQMLACPPHGLLDRVVTNVTIIVLLWAVIWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSCDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQAAIGSVALDTARSHGEKQLEDYGMDVLTVAFLSILITAPIGSLLIGLLGPRLLQKVEHQNKDEEVQGETSVQV

SEQ ID NO: 2596 - protein, 456 aa, Pongo abelii
MFLLLPFDSLIVNLLGISLTVLFTLLLVFIIVPAIFGVSFGIRKLYMKTLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 2597 - protein, 520 aa, Pongo abelii
MFCTRGLVFFAFPAGLDIEFTGLRSNLSGPQQISLFDLPSEWYLKTRQSVQQFTICQIGLSVFSAIEGEANKYTAHSCNFYLFPTTFGILDSEFSFQASSVQFLNQYGFNYNKFLKNGIPYMNEEQEKKIRHDILTGNWRVRSSPDKDQIKVVIDEVTRWLDLAKEGDWMTLPGITGFQAFEVQLVLRQALPNIWTVLKDEGVVVKKVSKQHRWYLQNTSCDRESCWKENILLSARGFSAFFQMLVKAQKPLVGHNMMMDLLHLHEKFFRPLPESYDQFKQNIHSLFPVLIDTKSVTKDIWKEMNFPRVSNLSKVYEVLNSDLNPTKNSGPEIVHASRCEKYVETKCPHEAAYDAFLCGSVLLKVAHLLLQKVHRIDPVPESSFPQYLDVLAPYVNQVNLIRAGVPKINFSGPDYPGIRPPILILSVKRWPGVSEQQVCHKFQNLCKFDVRRLTRSQFLLLTNKFKDARNILKEYRGHPTLCISLYRYWRHSPNVNCLLQVCGIVTAWALLAFTLGRSGP

SEQ ID NO: 2598 - protein, 693 aa, Pongo abelii
MNNKADSFFWNLRQFSTLVPTSRTMRLYRLGLCKPKIVHSNWNILSNFHNRMRSTDIIRYLFQDAFIFKSDVGFQTKGISTLTARRIERLLYARRLFFDSKQSLVPVDKSDDGLKKVNLNHEVSNEDVLTKETKPNRISSRKLSQECNSLSDVLDAFSKAPTFPSSNYFTAMWTIAKRLSDGQKRFEKRLMFSHPAFNQLCEHMMREAKIMQYKYLLFSLYSMVKLGIPQNTILVQTLLRVTQERINECDETCLSVLSAVLEAMEPCKNVHVLQMGFRILVDQQVWKIEDVFTLQVVMKCIGKDAPIALKRKLEMKALRELDRFSVLNSQHMFEVLAAMNHRSLTLLDECSKVVLDNIHGCPLRIMINILQSCKDLQYHNLDLFKGLADYVAATFDIWKFRKVLFILILFENLGFRPVGLMDLFMKRIVEDPESLNMKNILPTLHTYSSLNHVYKCQNKEQFLEVMASALTGYLHTISSENLLHAVYSFCLMNYFPLAPFNQLLQKDVISELLTSDDMKNVYKLHMLDTCLKLDDTVYLKDIALSLPQLPRELPPSHPNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFRVILVNNWEMDKLEMEDAVTFLKTKIYSVEALPVAAVNVQST

SEQ ID NO: 2599 - protein, 143 aa, Pongo abelii
VHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVI

SEQ ID NO: 2600 - protein, 81 aa, Pongo abelii
MKMIQLGKTVHYLPILFIDQLSNRVKDLMVINRSTTELPLTVSYDKVSLGRLRFWIHMQDAVYSLQQFGFSEKDADEVKGI

SEQ ID NO: 2601 - protein, 175 aa, Pongo abelii
MEKISVSAFLLLVALSYTLARDTTVKPAAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPTDTALLLDNMKKALKLLKTEL

SEQ ID NO: 2602 - protein, 61 aa, Pongo abelii
ILSLWKVGNCTNIVYPPCDVQTFLDIPLHEKKMTPGHLLVSVGQFRPEKNHPLQIRAFAKL

SEQ ID NO: 2603 - protein, 31 aa, Pongo abelii
LSLWKVGNCTNIVYPPCDVQTFLDIPLHEKK

SEQ ID NO: 2604 - protein, 375 aa, Pongo abelii
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSETQLMSDGTSRFTCKGKSIYHFGNTSTFCEYTVIKEISVAKIDAVAPLEKVCLISCGFSTGFGAAINTAKVTPGSTCAVFGLGGVGSSVVMGCKAAGATRIIGVDVNKEKFKKARELGATECLNPQDLKKPIQEVLFDMTDAGIDFCFEAIGNLDVLAAALASCNESYGVCVVVGLLPASVQLKISGQLFFSGRSLKGSVFGGWKSRQHIPKLVADYMAKKLNLDPLITHTLNLDKINEAVELMKTGKCIRCILLL

SEQ ID NO: 2605 - protein, 169 aa, Pongo abelii
MKGGISNVWFDRFKITNDCPEHLESIDVMCQVLTDLIDEEVKSGIKKNRILIGGFSMGGSMAMHLAYRNHQDVAGVFALSSFLNKASAVYQALQKSNGVLPELFQCHGTADELVLHSWAEETNSMLKSLGVTTKLHSFPDVYHELSKTELDILKLWILTKLPGEMEKQK

SEQ ID NO: 2606 - protein, 374 aa, Pongo abelii
MSVPAFIDISEEDQAAELRAYLKSKGAEISEENSEGGLHIDLAQIIEACDVCLKEDDKDVESVMNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 2607 - protein, 75 aa, Pongo abelii
VAALMLAKCLQLNVKKGSFVAKIIKVINFYLVCTLTITLNIIMKMFVPHKENGHMLKFLEVKFGLNMTKNFTMNW

SEQ ID NO: 2608 - protein, 86 aa, Pongo abelii
VAALMLAKCLQLNVKKGSFVAKIIKVINFYLVCTLTITLNIIMKMFVPHKENGHMLKFLEVKFGLNMTKNFTMNWLLCQESLQAPS

SEQ ID NO: 2609 - protein, 140 aa, Pongo abelii; identical to SEQ ID NO: 2471

SEQ ID NO: 2610 - protein, 84 aa, Pongo abelii; identical to SEQ ID NO: 2472

SEQ ID NO: 2611 - protein, 84 aa, Pongo abelii
EVSLPEAAASADLKIQIGCHTDDLTRASKLFRGPLVINRCCLDKPTKSITCLWGGLLYIIVPQNSKLGSVPVTVKGAVHAPYYK

SEQ ID NO: 2612 - protein, 66 aa, Pongo abelii
CHTDDLTRASKLFRGPLVINRCCLDKPTKSITCLWGGLLYIIVPQNSKLGSVPVTVKGAVHAPYYK

SEQ ID NO: 2613 - protein, 138 aa, Pongo abelii
KATLDEIQTVHSEYHTLLYGTSPLNRQKVDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDI

SEQ ID NO: 2614 - protein, 35 aa, Pongo abelii
TAMGFCFFNSVAITAKLLQQKLNVGKVLIVDWDIH

SEQ ID NO: 2615 - protein, 953 aa, Pongo abelii
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVDEKDASCKRNAFMMLIHADQDRALDYLSTCIDQVQTFGDILQLVIVELIYKACHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMIDLNDYLRHILKSTNMKCLTPEKALSGYCGFMAANLYARSIFGEDALANVSIEKPIHQGPDAAVTGHIRIRAKSQGMALSLGDKINLSQKKTSI

SEQ ID NO: 2616 - protein, 47 aa, Pongo abelii
WNAVLTLFVTSLIGALIPEPEVKIEVLQKPFICHRKTKGGDLMLVHY

SEQ ID NO: 2617 - protein, 325 aa, Pongo abelii
MAAMRKAVPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVAIFGAASELFTKKNINCSIEESFQRFDAILKAAQSANISVRGYVSCALGCPYEGKISPAKVAEVTKKLYSMGCYEISLGDTIGVGTPGIMKGMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 2618 - protein, 182 aa, Pongo abelii
MLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALEANIIPSFVLMDIQASTVVTYVYQLIGDDVKVERIEYKKS

SEQ ID NO: 2619 - protein, 418 aa, Pongo abelii
MLPNTGRLAGCTVFITGASRGIGKAIALKAAKDGANIVIAAKTAQPHPKLLGTIYTAAEEIEAVGGKALPCIVDVRDEQQINAAVEKAIKQFGGIDILVNNASAISLTNTLDTPTKRLDLMMNVNTRGTYLASKACIPYLKKSKVAHILNISPPLNLNPIWFKQHCAYTIAKYGMSMYVLGMAEEFKGEIAVNALWPKTAIHTAAMDMLGGPGIESQCRKVDIIADAAYSIFQKPKSFTGNFVIDESILKEEGIENFDVYAIKPGHPLQPDFFLDEYPEAVSKKMESTGAVPEFKEEKPQPQPKPRSGAVEETFRIVKDSLSDDVVKATQAVYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 2620 - protein, 1098 aa, Pongo abelii
MLEGDLASKMLRAVLQSHKNGVALPRLQGEYRSLTGDWIPFKQLGFPTLEAYLRSVPAVVRIETSRSGEITCYAMACTETARIAQLVARQRSSKRKTGRQVNCQMRVKKTMPFFLEGKPKATLRQPGFASNFSVGKKPNLAPLRDKGNSAVVKPDAEISPCMLHTTLGNEAFKDIPVQRHVTMSTNNRFSPKASLQPPLQMHLSRTSTKEMSDNLNQTVEKPNVTPPASYTYKMDEVQNRIKEILNKHNNGIWISKLPHFYKELYKEDLNQGILQQFEHWPHICTVEKPCSGGQDLLLYPAKRKQLLRSELDTEKVPLSPLPGPKQTPPLKGCPTVMAGDFKEKVADLLVKYTSGLWASALPKAFEEMYKVKFPEDALKNLASLSDVCSIDYISGNPQKAILYAKLPLPTDKIQKDAEQAHGDHDIKAMVEQEYLQLEENIAESANTFMEYITVPPLMIPTEASPSVLVVELSNTNEVVIRYVGKDYSAAQELMEDEMKEYYSKNPKVTPVQAVNVGQLLAVNAEEDAWLRAQVISTEENKIKVCYVDYGFSENVEKSKAYKLNPKFCSLSFQATKCKLAGLEVLSDDPDLVKVVESLTCGKIFAVEILDKADIPLVVLYDTSGEDDININATCLKAICDKSLEVHLQVDAMYTNVKVTNICSDGTLYCQVPCKGLNKLSDLLRKIEDYFHCKHMTSECFVSLPFCGKICLFHCKGKWLRVEITNVHSSRALDVQFLDSGTVTSVKVSELREIPPRFLQEMIAIPPQAIKCCLADLPQSIGMWTPDAVLWLRDSVLNCSDCSIKVTKVDETRGIAHVYLFTPKNFPDPHRSINRQITNADLWKHQKDVFLSAISSGAGSPNSKNGNMRVSGDTGENFRKNLTDVIKKSMMDHTSSFSTEELPPPVHLSKPGEHMDVYVPVACHPGYFVIQPWQEIHKLEVLMEEMILYYSVSEERHIAVEKDQVYAAKVENKWHRVLLKGILTNGLVSVYELDYGKHELVNIRKVQPLADMFRKLPFQAVTAQLAGVKCTQWSEEASMVFRNRVEKKPLVALVQTVIENANPWDRKVVVYLVDTSLPDTDIWIHDFMSEYLIELSKVN

SEQ ID NO: 2621 - protein, 129 aa, Pongo abelii
LVKVVESLTCGKIFAVEILDKADIPLVVLYDTSGEDDININATCLKAICDKSLEVHLQVDAMYTNVKVTNICSDGTLYCQVPCKGLNKLSDLLRKIEDYFHCKHMTSECFVSLPFCGKICLFHCKGKWL

SEQ ID NO: 2622 - protein, 199 aa, Pongo abelii
LVKVVESLTCGKIFAVEILDKADIPLVVLYDTSGEDDININATCLKAICDKSLEVHLQVDAMYTNVKVTNICSDGTLYCQVPCKGLNKLSDLLRKIEDYFHCKHMTSECFVSLPFCGKICLFHCKGKWLRVEITNVHSSRALDVQFLDSGTVTSVKVSELREIPPRFLQEMIAIPPQAIKCCLADLPQSIGMWTPDAVL

SEQ ID NO: 2623 - protein, 119 aa, Pongo abelii
AVQPKAAGSSLLNKIANSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDYILCIH

SEQ ID NO: 2624 - protein, 46 aa, Pongo abelii
VLDIIKLAGVHTVANCFVVPMATGMSLTLCFLTLRHKRPKAKYIIW

SEQ ID NO: 2625 - protein, 656 aa, Pongo abelii
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGRHVATGTFALTSLISANAVERIVPQNMQNLTTQSNTSVLGLSDFEMQRIRVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFILIVIYAIGPLLYWLPMCVLASIIVVGLKGMLIQFRDLKKYWNVHKIDWGIWVSTYVFTICFAANVGLLFGVVCTIAVVIGRFPRTMTVSIKNMKEMEFKVKTEMDSETLQQVKIISINNPLVFLNAKKFYTDLMNIIQKENACNQPLDDISKCEQNTLLNSLSNGNCNEETSQSCPNEKCSLILDCSGFTFFDYSGVSMLVEVYMDSKGRSVDVLLAHCTASLIKAMTYYGNLDSEKPIFFESVSAAISHIHSNKNLSKLSDHSEV

SEQ ID NO: 2626 - protein, 548 aa, Pongo abelii
MALHVPKAPGFAQMLKEGAKHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 2627 - protein, 320 aa, Pongo abelii
MSVGFIGAGQLAYALARGFTAAGILSAHKIIASSPEMNLPTVSALRKMGVNLTRSNKETVKHSDVLFLAVKPHIIPFILDEIGADVQAGHIVVSCAAGVTISSVEKKLMAFQPAPKVIRCMTNTPVVVQEGATVYATGTHALVEDGQLLEQLMSSVGFCTEVEEDLIDAVTGLSGSGPAYAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 2628 - protein, 305 aa, Pongo abelii
MDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKIGTNQMAVCAKAQNKPFYVVAESFKFVRLFPLNQQDVPDKFKYKADTLKVAQTGQDLKEEHPWVDYTAPSLITLLFTDLGVLTPSAVSDELIKLYL

SEQ ID NO: 2629 - protein, 443 aa, Pongo abelii
MVRGRIFRLSVRDVRFPTSLGGHGSDAMHTDPDYSAAYVVIETDAEDGIKGCGITFTLGKGTEVVVCAVNALAHHVLNKDLKDIVGDFRGFYRQLTSDGQPRWIGPEKGVVHLATAAVLNAVWDLWAKQEGKPVWKLLVDMDPRTLVSCIDFRYITDVLTEEDALEILQKGQVGKKEREKQMLAQGYPAYTTSCAWLGYSDDTLKQLCAQALKDGWTRFKVKVGADLQDDVRRCQIIRDMIGLEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRMCEYVDHLHEHFKYPVMIQRASYMPPKDPGYSTEMKEESVKKHQYPDGEVWKKLLAAQEN

SEQ ID NO: 2630 - protein, 677 aa, Pongo abelii
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWILKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 2631 - protein, 718 aa, Pongo abelii
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFIVFRHRVLIFITEKHGNYFAYVQMFNSRILTKYTLLLGQDENSVVESFTASVDRKFISLMSLSSDGCIYETLIPIRPTDPEKNQSLVRSLLLKAVVSDNTQNGVALTALDQDHVAVLGSPLAASKECLSVWNIKFQTLQTSKELSQGTSGQVWYYGEHLFMLHGKSLTVIPYKCEVSSLAGALGKLKHSQDPGTHVVPHFVNWETPQGCGLGFQNSEQSRRILRRRKTEVSLQPEVPPSKQLLSTIMKDSEKHIEVEVRKFLALKQTPDFHTVVGDTVTGLLERCKAEPSFYPRNCLMQLIQTHVLSYSLCPDLMEIALKKKDVQLLQLCLQQFPDIPESVTCACLKIFLSIGDDSLQETDVSMESVFDYSNSVHDEKMEEQTEILQNGFNPEEDKCNNCDQELNKKPQDETKESTSCPVVQKRAALLNAILHSAFSETFLLPHLKDIPAQHITLFLKYLYFLYLKCSENATMTLPGIHPPTLNQIMDWICLLLDANFTVVVMMPEAKRLLINLYKLVKSQITVYSELNKIEVSFRELQKLNQEKNNRGLYSIEVLELF

SEQ ID NO: 2632 - protein, 124 aa, Pongo abelii
MPAPAATYERVVYKNPSEYHYMKVCLEFQDCGVGLNAAQFKQLLISAVKDLFGEVDAALPLDILTYEEKTLSAILRICSSGLVKLWSSLTLLGSYKGKKCAFRVIQVSPFLLALSGNSRELVLD

SEQ ID NO: 2633 - protein, 40 aa, Pongo abelii
PEQPYVTKVKTWRMHLFICIQLGCIALLWVVKSTAASLAF

SEQ ID NO: 2634 - protein, 28 aa, Pongo abelii
YVTKVKTWRMHLFICIQLGCIALLWVVK

SEQ ID NO: 2635 - protein, 101 aa, Pongo abelii
QDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVD

SEQ ID NO: 2636 - protein, 96 aa, Pongo abelii
VLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAV

SEQ ID NO: 2637 - protein, 152 aa, Pongo abelii
LMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFV

SEQ ID NO: 2638 - protein, 99 aa, Pongo abelii
ILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVY

SEQ ID NO: 2639 - protein, 88 aa, Pongo abelii; identical to SEQ ID NO: 1404

SEQ ID NO: 2640 - protein, 48 aa, Pongo abelii; identical to SEQ ID NO: 1405

SEQ ID NO: 2641 - protein, 236 aa, Pongo abelii
MAEPSAATQSPSISSSSSGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 2642 - protein, 375 aa, Pongo abelii
MSTAGKVIKCKAAVLWELKKPFSIEEVEVAPPKAQEVRIKMVAVGICGTDDHVVSGTMVTPLPAILGHEAAGIVESVGEGVTTVKPGDKVIPLAVPQCGKCRICKNPESNYCLKNDVSNPQGTLQDGTSRFTCRGKPIHHFLGISTFSQYTVVDENAVAKIDAASPLAKVCLIGCGFSTGYGSAVNVAKVTPGSTCAVFGLGGVGLSVVMGCKAAGAARIIAVDINKDKFAKAKELGATECINPQDYNKPIQEVLKEMTDGGVDFSFEVIGRLDTMMASLLCCHEACGTSVIVGVPPDSQNLSMNPMLLLTGRTWKGAVLGGFKSKECVPKLVADFMAKKFSLDALITHVLPFEKINDGFDLLHSGKSIRTILMF

SEQ ID NO: 2643 - protein, 854 aa, Pongo abelii
MLITERKYFWSGRIAQSRSEANLVDMEAGKLSKSCNITECQDPDLLHNWPDAFTLHGNNASKVTNPFWNQLSASNPFLDDITQLRNNRKRNNISILKEDPLLFFREIENGNSFDSSGDELDVHQLLRQSSSRKSGRSKSVSELLDILDDTAHAHQSIHNSDQILLHDLEWLKNDREAYKMAWLSQRQLARSCLDLNTISQSPGWAQTQLAEVTKACKVNHQGGSVQLPESDITVHVPQGHVAVGEFQEVSLRAFLDPPHMLNHDLSCTVSPLLEIMLGNLNTMEALLLEMKIGAEVGKDPFSQVMTEMVCLHSLGKEGPFKILSNCYIYKDTIQVKLIDLSQVMYLVVAAQAKALQSPAATIWDYIHKTTSIGIYGPKYIHPSFTVVLTVCGHNYMPGQLTISDIKKCGKNISPVVFQLWGKQSFLLDKPQDLSISIFSCDPDFEVKTEGERKEIKQKQLEAGEVVHQQFLFSLVEHREMHLFDFCVQVELPNGEPVAQFCITTPDPTPNLKRLSNLPGYLQKKEEIKSAPLSPKILVKYPTFQDKTLNFTNYGVTLKAVLRQSKIDYFLEYFKGDTIALLGEGKVKVIGQSKVKEWYVGVLRGKIGLVHCKNVKVISKEQVMFMSDSVFTTRNLLEQIVLPLKKLTYIYSVVLTLVSEKVYDWKVLADVLGYSHLSVEDFDQIHADKESEKVSYVIKKLKEDCHTKRNTRKFLYELIVALLKMDCQALVARLIREAAVLTSAVKLGKGWRELAEKLVRLTKQQMEAYEIPHRGNTGDVAVEMMWKPAYDFLYTWSAHYGNNYRDVLQDLQSALDRMKNPVTKHWRELTGVLILVNSLEVLRVTAFSTSEEVWK

SEQ ID NO: 2644 - protein, 114 aa, Pongo abelii
LGNLNTMEALLLEMKIGAEVGKDPFSQVMTEMVCLHSLGKEGPFKILSNCYIYKDTIQVKLIDLSQVMYLVVAAQAKALQSPAATIWDYIHKTTSIGIYGPKYIHPSFTVVLTV

SEQ ID NO: 2645 - protein, 87 aa, Pongo abelii
EALLLEMKIGAEVGKDPFSQVMTEMVCLHSLGKEGPFKILSNCYIYKDTIQVKLIDLSQVMYLVVAAQAKALQSPAATIWDYIHKTT

SEQ ID NO: 2646 - protein, 32 aa, Pongo abelii
LDRIFVCDKHKILFCQTPKVGNTQWKKVLIVL

SEQ ID NO: 2647 - protein, 161 aa, Pongo abelii
QWLLLAACFWVIFMFMVASKFITLTFKDPDVYSAKQEFLFLTTMPEVRKLPEEKHIPEELKPTGKELPDSRLVQPLVYMERLELIRNVCRDDALKNLSHTPVSKFVLDRIFVCDKHKILFCQTPKVGNTQWKKVLIVLNGAFPSIEEIPENVVHDHEKNGL

SEQ ID NO: 2648 - protein, 333 aa, Pongo abelii
MFRAAAPGQLRRAASLLRFQSTLVIAEHADDSLAPITLNTITAATRLGGEVSCLVAGTKCDKVAQDLCKVAGIAKVLVAQHDVYRGLLPEELTPLILATQKQFNYTHICAGASAFGKNLLPRVAAKLEVAPISDIIAIKSPDTFVRTIYAGNALCTVKCDEKVKVFSVRGTSFEAAATSGGSASSEKASSTSPVEISEWLDQKLTKSDRPELTGAKVVVSGGRGLKSGENFKLLYDLADQRHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 2649 - protein, 349 aa, Pongo abelii
MASKKVCIVGSGNWGSAIAKIVGGNAAQLAQFDPRVTMWVFEEDIGGKKLTEIINTQHENVKYLPGHKLPPNVVAVPDVVQAAADADILIFVVPHQFIGKICDQLKGHLKANATGISLIKGVDEGPNGLKLISEVIGEHLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFRSGPVSSATFLESCGVADLITTCYGGRNRKVAEAFARTGKSIEQLEKELLNGQKLQGPETARELHSILQHKGLVDKFPLFMAVYKVCYEGQPVGEFIRCLQNHPEHM

SEQ ID NO: 2650 - protein, 904 aa, Pongo abelii
MSGGSQVHIFWGAPVAPLKMTVSQDTASLMSVADPWKKIHLLYSQHSLYLKDEKQHKNLENYEVPESVGSPDFSGHFLANCMNRHVHVKDDFVRSVSETQNIESQNIHSSRLSDITSSNMQICGFKSTVPHLTEEEKYQKLLSENKIIDEQPKHQSDICGQNFNTNLFQLGHKCAAMLDLVCSTEQINIGPEVVQRECVSTEYHEIQNQCLGLFSSNAVDKSRSEAAVRKASDLKISTDTEFLSIITSSQVAFLAQKKDKGRSPINKGNVNMETEPKASYREIRIPEENSIQLDGFTEAYEGGQNQAYSLELFSPVCRKTENSRIHINSDKGLEEHIGSQELFNSEDKLPPNEIHIELCSSGILCSQLNTFHKSAIKRSCTSEDKVGQSEALSRVLQVAKKMKLISNGGDSAVEMDRRNVSEFKGIKKTSLIKNCDSKSQKYNCLVMVLSPCHVKEINIKFGPNSGSKVPLATVTVIDQSETKKKVFLWRTAAFWAFTVFLGDIILLTDVVIREDQWVGETVLQSTFSSQLLNLGSYSSIQPEEYSSVVSDVVLQDLLAYVSSKHSYLRDLPPRQPQRVNSIDFVELEHLQPDVLVHAVLRVVDFTILTEAVYSYRGQKQKKVMLTVEQAQDQHYVLVLWGPGAAWYPQLQRKKGYIWEFKYLFVQRNYTLENLELHTTPWSSCECLFNDDIRAITFKAKFQKSAPSFVKIPDLATHLEDKCSGVVLIQAQISELAFPITAAQKIALNAHSSLKSIFSSLPNIVYTGCAKCGLELETDENRIYKQCFSCLPFTMKKIYYRPALMTVVDGRHDVCIRVESKLIEKILLNISADCLNRVIVPSSEITYGMVVADLFHSLLAVSAEPCVLKIQSLFVLDENSYPLQQDFSLLDFYSDIVKHGADARL

SEQ ID NO: 2651 - protein, 72 aa, Pongo abelii
YVNMTLPVDAVISVAPEETWGKVRKLLVDAIHNQLTDMEKCILKYMKGTSIVVPEPLHFLLPGKKNLVTISY

SEQ ID NO: 2652 - protein, 76 aa, Pongo abelii
DAVISVAPEETWGKVRKLLVDAIHNQLTDMEKCILKYMKGTSIVVPEPLHFLLPGKKNLVTISYPSGIPDGQLQAY

SEQ ID NO: 2653 - protein, 418 aa, Pongo abelii
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHSEILEGLHFNLTEIPEAQVHEGFQELLRTLNQPDSQLQLTTGNGLFLNESLKLVDKFLEDVKKLYHSDAFTVNFGDTEEAKKQINDYVEKGTQGKIVDLVKELDRDTVFALVNYIFFKGKWERPFEVKDTKEEDFHVDEVTTVKVPMMRRLGMFNIHYCEKLSSWVLLMKYLGNATAIFFLPDEGKLQHLENELTHDIITKFLENENRRSASLHLPKLSITGTYDLKRVLGQLGITKVFSNGADLSGVTEEAPLKLSKAVHKAVLTIDEKGTEAAGAMFLEAIPMSIPPEVKFNKPFVFLMIEQNTKSPLFVGKVVNPTQK

SEQ ID NO: 2654 - protein, 552 aa, Pongo abelii
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNIMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 2655 - protein, 267 aa, Pongo abelii
MAEPVQEELSALAAIFCGPHEWEVLSRSETDGTVFRIHTKAEGFMDADIPLESVFHLPVNYPSCLPGISINSEQLTRAQCVTVKEKLLEQAESLLSEPMVHELVLWIQQNLRHILNQPETGSGYEKCTFSTSTTVDDGLWITLLHLDHMRAKTKYVKTVEKWASDLRLTGRLMFMGKIILILLQGDRNNLKEYLILQKTSKVDVDSSGKKCKEKMISVLFETKVQTEHKRFLAFEVKEYSALDELQKEFETAGLKKLFSEFVLALVK

SEQ ID NO: 2656 - protein, 426 aa, Pongo abelii
MAIAHLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLRQSLWEVSESHFKYPIVEQYLKTKKNSNNLIIKYISCRLLTLIIILLACIYLGYYFSLSSLSGEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTAMSAETREEHGNQTAELQAMNIDGETKANNGEKNARQRLLNSSC

SEQ ID NO: 2657 - protein, 578 aa, Pongo abelii
MACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLRTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLSHLAAVAHKTLQIKDSPPEVAGARLHLFKAVRSVLANGMKLLGITPVCRM

SEQ ID NO: 2658 - protein, 323 aa, Pongo abelii
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLIITVIVIVGAILFVPGEYSLKNATGLGLIVTSTGILILLHYYVFSTAIGLNSFVIAILVIQVIAYILAVVGLSLCIAACIPMHGPLLISGLSILALAQLLGLVYMKFVASNQKTIQPPRKAVEEPLNAFKESKGMMNDE

SEQ ID NO: 2659 - protein, 397 aa, Pongo abelii
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRTVRFGTKLGSDIKLEDSLWVSLTDQHVQLPIAMTAENLAVKHKISREECDKYALQSQQRWKAANDAGYFNDEMAPIEVKTKKGKQTMQVDEHARPQTTLEQLQKLPPVFKKDGTVTAGNASGIADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 2660 - protein, 689 aa, Pongo abelii
MAPWPELGDAQPNPDKYLEGAAGQQPTAPDKSKETNKNNTEAPVTKIELLPTYSTATLIDEPTEVDDPWNIPTLQDSGIKWSERDTKGKILCVFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVDSFHSKNGEDAPDLLKVITKPFTKLIVQLDKKIISQIAMNDEKAKNKSLVKIWCKTFTNKTQVNVTVPSTANCTSPSLCWTDGIQTWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVFSKFTGCFQMRCCCCCRVCCRACCLLCGCPKCCRCSKCCEDLEEAHEGQDVPVKAPDTFDNITISREAQGEVPASDSKTECTAL

SEQ ID NO: 2661 - protein, 197 aa, Pongo abelii
ALMQVGDRSEFRRAFAGATVHDFFNWLSVLVLLPVEVATHYLEIITQLIVDSFHSKNGEDAPDLLKVITKPFTKLIVQLDKKIISQIAMNDEKAKNKSLVKIWCKTFTNKTQVNVTVPSTANCTSPSLCWTDGIQTWTMKNVTYKENIAKCQHIFVNFHLPDLAVGTILLILSLLVLCGCLIMIVKILGSVLKGQVA

SEQ ID NO: 2662 - protein, 74 aa, Pongo abelii
WTMKNVTYKENIAKCQHIFVNFHLPDLAVGTILLILSLLVLCGCLIMIVKILGSVLKGQVATVIKKTINTDFPF

SEQ ID NO: 2663 - protein, 138 aa, Pongo abelii
TFVVVKDPDVKHKIRKIIEGEEEINYMKRMGHRWVTDLKKLRTNWIKEYLDTAPILILIFKQVHGFVANGKKKVHYYNEISVSIACGILLAALQNAGLVTVTTTPLNCGPRLRVLLGRPAHEKLLMLLPVGYPSKEAM

SEQ ID NO: 2664 - protein, 97 aa, Pongo abelii
WIKEYLDTAPILILIFKQVHGFVANGKKKVHYYNEISVSIACGILLAALQNAGLVTVTTTPLNCGPRLRVLLGRPAHEKLLMLLPVGYPSKEAMVPD

SEQ ID NO: 2665 - protein, 527 aa, Pongo abelii
MRSEKSALVFLLLQLFCVGCGFCGKVLVWPCDMSHWLNVKVILEELIVRGHEVTVLTHSKSLLIDYRKPSALKFEVVHMPQDKTEGNEVFVDLALNVLPGLPTWQSVIKLNDFFVEIRGTLKMMCESFIYNQTLMKKLQETNYDVMLIDPVIPCGDLMAELLAVPFVLTLRISLGGNMERSCGKLPAPLSYVPVPMTGLTDRMTFLERVKNSMLSVFFHFWIQDYDYHFWEEFYSKALGRPTTLCETVGKAEIWLIRTYWDFEFPQPYQPNFEFVGGLHCKPAKALPKEMENFVQSSGEDGIVVFSLGSLFQNVTEEKANIIASALAQIPQKVLWRYKGKKPSTLGTNTRLYDWIPQNDLLGHPKTKAFITHGGMNGIYEAIYHGVPMVGVPIFGDQLDNIAHMKAKGAAVEINFKTMTSEDLLRALRTVTTNSSYKENAMRLSRIHHDQPVKPLDRAVFWIEFVMRHKGAKHLRSAAHNLTWFQHYSIDVIGFLLACVATAIFLFTKCCLFSCQKFNKTRKIEKRE

SEQ ID NO: 2666 - protein, 1098 aa, Pongo abelii
MRTSLQAVALWGQKAPPHSITAIMITDDQRMIVTGSQEGQLCLWNLSHELKISAKELLFGHSASVTCLARARDFSKQPYIVSAAENGEMCVWNVTNGQCVEKATLPYRHTAICYYHCSFRMTGEGWLLCCGEYQDVLIIDAKTLAVVHSFRSSQFPDWINCMCIVHSMRIQDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNSGLSKSIYPADGRVLKETIYPHLLCSTSVQENKNRPFVMGYMNERKEPFYKVLFSGEVSGRITLWHIPDVPVSKFDGSPREIPVTATWTLQDNFDKHDTVSQSIIDYFSGLKDGAGTAVVTSSEYIPSLDKLICGCEDGTIIITQALNAAKARLLEGGSLVKDSSPHKVLKGHHQSVTSLLYPHGLSSKLDQSWMLSGDLDSCVILWDIFTEEILHKFFLEAGPVTSLLMSPEKFKLRGAQIICCVCSDHSVALLHLEGRSCLLRARKHLFPVKMIKWHPVENFLIVGCADDSVYIWEIETGTLERHETGERARIILNCCDDSQLVKSVFPIASETLKHKSIEQRSSSPYQLGPLPCPGLQVESSCKVIDAKFCPRPFNVLPVKTKWSNVGFHILLFDLENLVELLLPTPLSDVDSSSSFYGGEVLRRAKSTVEKKTLTLRKSKTACGPLSAEALAKPITESPAQGDNTIKFSAENDGIKRQKKMKISKKMQPKPSRKVDASLTIDTAKLFLSCLLPWGVDDLDYLCIKHLNILKLQGPISLGFASNEDNFSLMLPGWDLCNTEMIKDYSGVNLFSRKVLDLSDKYTATLPNQVGIPRGLENNCDSLQESDTIVYLLSRLFLVNKLVNMPLELACRVGSSFRMECVHNKVRSAGNDILNMSSFYSCLRNGKNESHVPEADLSLLKLISCWRDQSVQVTEAIQAVLWAEVQQHMKSLGKIPVNSQPVSMAENGNCEMKQMLPKLEWTEELELQCIRNTLPLQTPVSPVKHDSNLNSANIQDMEDMPDRCVLEESESPGEPRHHSWIAKVCPCKVS

SEQ ID NO: 2667 - protein, 107 aa, Rattus norvegicus; identical to SEQ ID NO: 515

SEQ ID NO: 2668 - protein, 85 aa, Danio rerio
TEISKKIRTAIKGKLQEFGAYVDEELPDYIMVMVANKKNPQQMADDLSLFLGNNTIKFTVWLHGVLEKLRSVAVEPPSLGPSVVH

SEQ ID NO: 2669 - protein, 177 aa, Danio rerio
MAGLWRSYQALMAKHPWKVQIITAGSLVGVGDVISQQLIERRGLANHNARRTAKMMSIGFFFVGPVVGGWYKVLDKLVTGGTKSAALKKMLVDQVGFAPCFLGAFLGITGTLNGLTVEENVAKLQRDYTDALISNYYLWPPVQIANFYFIPLHHRLAVVQIVAVVWNSYLSWKANKM

SEQ ID NO: 2670 - protein, 96 aa, Rattus norvegicus
QIPTVGLGTWKASPGEVTDAVKVAINLGYRHFDCAYLYHNESEVGMGIKEKIKEGVVKRDELFIVSKLWCTYHKQSLVKTACINTLEALNLDYLDL

SEQ ID NO: 2671 - protein, 30 aa, Rattus norvegicus
VKRDELFIVSKLWCTYHKQSLVKTACINTL

SEQ ID NO: 2672 - protein, 858 aa, Rattus norvegicus
MFTLAEVASLNDIQPTYRILKPWWDVFMDYLAVVMLMVAIFAGTMQLTKDQVVCLPVLPSPANSKAHTPPGNADVTTEVPKMETATPQDQNGQTTNDIAFGTSAVTPDIPLQATYSHAESTFPSQETKKEKRDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTLIKTAKFIFILCYTANFVNAISFEHVCKPKVEHLTGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHVSRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNSIRTIEEIISFQHLKRLTCLKLWHNKIVAIPPSITHVKNLESLYFSNNKLESLPVAVFSLQKLRCLDVSYNNISTIPIEIGLLQNLQHLHITGNKVDVLPKQLFKCVKLRTLNLGQNCIASLPEKISQLSQLTQLELKGNCLDRLPAQLGQCRMLKKSGLVVEDQLFDTLPLEVKEALNQDVNVPFANGI

SEQ ID NO: 2673 - protein, 365 aa, Danio rerio
MTVRRVNVVILVLLVVAFLIVLHRNLLNLNDFLNQETSDTVPGMILPFETDFLLGRKAMRSGEEIPVLITAPEERLGAAVTAMNSIYRNSKANVVFNIVTLNESVVHLSTWLSKTDLKHKIIVFDPSILLGKIPTDAQKMETVRPLTFARFYMPAFLPDAEKAIYLDDDVIVQGDIRELFNTSLKSGHVAAFSEDCDSASSKGIVRGAGNQNSYIGYLDFKKEAIKKLGMRANTCSFNPGVFVANLTEWKQQNVTSQLEFWMERNAKEDLYSKTLADCMTTPPMLIVFYKHHSNIDPMWNVRHLGATGAGNRYSAQFVKAAKLLHWNGHYKPWGRTSSFSDIWDKWYIPDPTGKFHPIRKHVEEK

SEQ ID NO: 2674 - protein, 278 aa, Xenopus laevis
MQVHERSHTGGHTFQCNHGNEKKAPAAGKVHSEGGSARMSLLILVSIFLCAASVMFLVYKYFPQLSEEELEKIKVPRDMDDAKALGKVLSKYKDTFYVEVLVAYFTTYIFLQTFAIPGSIFLSILSGFLYPFPLALFLVCLCSGLGASFCYLLSYLVGRPVVYKYLSDKAIKWSQQVERHRDHLINYIIFLRITPFLPNWFINITSPVINVPLKVFFLGTFIGVAPPSFVAIKAGTTLYQLTTAGEAVSWNSVIILMVLAVLSILPAIFQKKLKQKFE

SEQ ID NO: 2675 - protein, 556 aa, Streptococcus pyogenes
MKSDIEIAQSVALQPITDIVKKVGIDGDDIELYGKYKAKLSFEKMKAVEANEPGKLILVTAINPTPAGEGKSTMSIGLADALNQMGKKTMLALREPSLGPVMGIKGGAAGGGYAQVLPMEDINLHFTGDMHAITTANNALSALIDNHLQQGNDLGIDPRRIIWKRVLDLNDRALRQVIVGLGSPVNGVPREDGFDITVASEIMAILCLATDLKDLKKRLADIVVAYTYDRKPVYVRDLKVEGALTLILKDAIKPNLVQTIYGTPALIHGGPFANIAHGCNSVLATSTALRLADYTVTEAGFGADLGAEKFLNIKVPNLPKAPDAIVIVATLRALKMHGGVAKSDLAAENCEAVRLGFANLKRHVENMRQFKVPVVVAINEFVADTEAEIATLKALCEEIKVPVELASVWANGAEGGLALAKTVVRVIDQEAADYKRLYSDEDTLEEKVINIVTQIYGGKAVQFGPKAKTQLKQFAEFGWDKLPVCMAKTQYSFSDNPSLLGAPTDFDITIREFVPKTGAGFIVGLTGDVMTMPGLPKVPAAMAMDVAENGTALGLF

SEQ ID NO: 2676 - protein, 801 aa, Streptococcus pyogenes
MLVSYKWLKELVDIDVTPAALAEKMSTTGIEVEGIEVPAEGLSKLVVGHVLSCEDVPETHLHLCQVDTGDETPRQIVCGAPNVKAGIKVIVAVPGARIADNYKIKKGKIRGMESLGMICSLQELGLSDSIIPKEFSDGIQILPEEAVPGDAIFKYLDLDDHIIELSITPNRADALSMRGVAHEVAAIYGKSVSFPQKNLQESDKATSEAIEVAIASDKVLTYASRVVENVKVKPSPQWLQNLLMNAGIRPINNVVDVTNYVLLYFGQPMHAFDYDKFEDHKIVARAARQGESLVTLDGEKRDLTTEDLVITVADKPVALAGVMGGQATEIDGNSQTVVLEAAVFDGKSIRKTSGRLNLRSESSSRFEKGVNYATVLEALDFAAAMLQELAEGQVLSGHVQAGQLPTEPVEVSTSLDYVNVRLGTELTFADIQRIFNQLGFGLTGDETRFTVAVPRRRWDISIPADLVEEIARIYGYDKLPTTLPEAGGTAAELTPTQALRRKVRGLAEGLGLTEIISYALTTPEKAIEFAVAPSHLTELMWPMSVERSALRQNMVSGMLDTVAYNVARKQSNLALYEIGKIFEQEVNPKEDLPNEVNHFAFAICGLVAQKDFQTQAQAVDFYHAKGILDTLFANLNLKVQYVPTKDLANMHPGRTALILLDEQVIGFVGQVHPGTAKAYSIPETYVAELDMAALEAALPSDQTFVEITKFPAMTRDVALLLDREVSHQTIVTAIESAGVKRLTKIKLFDVYEGATIQAGQKSMAYSLTFQNPNDNLTDEEVAKYMEKITKSLTEQVGAEVR

SEQ ID NO: 2677 - protein, 878 aa, Mus musculus
MGDHLEKSQHALLNEGDENEMEIFGYRTQGCRKALCLIGSIFSLGMLPLVFYWRPAWRVWANCVPCSLQEADVVLLKTTDEFKIYSWKKVIWISLSALSSTSGLTPDHPLITDEGYIINRAIRKPDLKVRYIKVQKIRYVWNNLEGQFQKIGSLEDWLSSAKIHQKFGLGLTSEEQEIRRLICGPNAIDVEITPIWKLLIKEVLNPFYIFQLFSVCLWFSEDYKEYALAIILMSVISIALTVYDLRQQSVKLHHLVESHNSITVSVYERKAGAQDLESRLLVPGDLLILTGSRVQMPCDAILIDGSCVVDEGMLTGESIPVTKTPLSQTASSVPWKMQSEADPRRHVLFCGTEVIQAKAAGSGAVRAVVLQTGFNTAKGDLVRSILYPKPMNFKLYRDAIRFLLCLVGTATIGMVYTLCVYVLSGEPPEEVVRKALDVITIAVPPALPAALTTGIIYAQRRLKKKGIFCISPQRINVCGQLNLVCFDKTGTLTRGGLDPWGVVPCDQNGFQAVHSFASGKALPQGPLCAAMASCHSLILLDGTIQGDPLDLKMFEATKWEMTASGDDLHIKEMLAHTIVVKPTDMVGQVPAEGLAIVHQFPFSSALQRMTVIVQEMGGGRLAFMKGAPERVASFCQPDTVPTSFISELQIYTTQGFRVIALAYKKLEMDCPTTALMREKVESDLVFLGLLILENRLKEETKPVLEELISARIRTVMITGDNLQTAITVARKSGMVSEGQKVILVEANEATGSSSASISWKLVEEKKPGPFGSQDTYINIREEVPENGRDRSYHFALSGKSFHVISQYFSSLLPKLVMNNFLGSSCVFAFSWVLLYVSIVIPRIPLVQLSVKLKIFQDMAEKAVFSMAAGFNYTGHLKK

SEQ ID NO: 2678 - protein, 261 aa, Xenopus tropicalis
MFVPIGSEQDFPSDYTLLLPAISVGNVGQLAIDLIISTLKIPKVGYFYTDCLVPMVGSNPYETDEENAKELCTNAEVYALPSQKLAVLQLRSLVIKKKSKSFRQALVSWIKRCAFARVILLSSCHAYHRDDTQLFGTPFRYLVTPALQKSVADVLKELEWKEMEKVSSYPGLNDNEKRVFIPGGGFTKRFYDDCCLEDLQMAVVLKFCSEGDNVPDAFSLLNQVNEWLHLVASTNGDVLAKWKAPGSWQLLFGSGLPAAIF

SEQ ID NO: 2679 - protein, 515 aa, Xenopus tropicalis
MSGYKPVAIPTYPKLGEKITQDTLYWKRYKTPVQIKEFGAVTKIHFSPVQPCTYAVTSSTRIHLYGQYSQEPIKTFSRFKDTAYCGTFRGDGKLLAAGCEDSVVQLFDISGKAALRQFSGHSKAVHFVDFTADKYRIVSGSDDYTSRLWDIPNGVEITSYNEHTDYIRCGCTSALNNDLFATGSYDHTIKIFDGRTDKSVMSMDHGQPVESVLLFPSGGLLVSAGGRYVKVWDILKGGQLLVSLRNHHKTVTSLCLSSSGQRLLSASLDRHVKVYSTMNYKVVHSFDYAASILSLALAPDDQMIVVGMTNGVLNIKHRKPEERKQLQSTTKRHPRYRVFVRGKDYMPKQDDIFISKPVIAHLKKYDKLLKGFHMTEALDTVLQPQIRNQRPEVTVAVMNELKRRGTLKNALAGRNEKQLSDLLIFLLKHLVNPQFVPILLNVAEHIIDIYSPVVGQSSVIYKQFIRLQEVLEKEINYQEELLKMLGMMDTLFATMTTKKESPWEEPKPILPLSSQ

SEQ ID NO: 2680 - protein, 72 aa, Xenopus laevis
LEWTKICEKSSKIITFIDLAGHEKYLKTTVFGMTGHLPDFCMLMVGSNAGIVGMTKEHLGLALALNVPVFVV

SEQ ID NO: 2681 - protein, 119 aa, Xenopus laevis
EWTKICEKSSKIITFIDLAGHEKYLKTTVFGMTGHLPDFCMLMVGSNAGIVGMTKEHLGLALALNVPVFVVVTKIDMCPANILQETLKLLQRLLKSPGCRKIPVLVQNKDDVIVTASNF

SEQ ID NO: 2682 - protein, 56 aa, Xenopus laevis
DIVPITRLKSGLNVMEMWHGVTHAFKDLAMSCVGELLDYFLKRKNKHVTILVATSG

SEQ ID NO: 2683 - protein, 49 aa, Xenopus laevis
IVPITRLKSGLNVMEMWHGVTHAFKDLAMSCVGELLDYFLKRKNKHVTI

SEQ ID NO: 2684 - protein, 374 aa, Xenopus tropicalis
MKGSEEAYLVSDKATKMYSLTKDSEKNHPSKPPLQDEENPQSKYHCHNNNKKAYDARQREQTFAKKKLCIASLICFVFISAEIVGGYIAGSLAVVTDAAHLLVDLSSFFISLCSLWLSSKSSTTRLTFGWHRAEILGALMSVITIWLVTGVLVYLACERLIRPDYTIDGTVMLITSACALGANLVLALILHQSGHGHSHAGGKHEHMASEYKPQTNASIRAAFIHVIGDLFQSISVLISALIIYFKPEYKMADPICTFIFSIFVLITTVTVLRDLLTVLMEGTPRGIHYSDVKQSILAVDGVKSVHSLHLWALTMNQVILSAHIATDIVGESKRILKDVTQNVFARFPFHSVTIQVEPIEDQSPECMFCYEPTQ

SEQ ID NO: 2685 - protein, 432 aa, Rattus norvegicus
MDDAVGDLKQALPCVAESPAVHVEVLQRSGSTAKKEDIKQSVYRLLKRHNIVFGDYVWTEFDEPFLTRNVQSVSIVDTELKAKDPQPIDLSACTIALHIFQLNEEGPSSENLDEETENIIAASHWVLPAAEFHGLWDSLVYDVEVKSHLLDYVMTTLLFSDKNVDSNLITWNRVVLLHGPPGTGKTSLCKALAQKLTIRLSSRYRYGQLIEINSHSLFSKWFSESGKLVTKMFQKIQDLIDDKEALVFVLIDEVESLTAARNACRAGAEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLSEISRKSEGLSGRVLRKLPFLAHALYIQAPSVTIEGFLQALSLAVDKQFEEKKKLSAHV

SEQ ID NO: 2686 - protein, 132 aa, Rattus norvegicus
LAWAFSRRVSAHRPQPTLPHHLIRHYPTTRCGKVKFYTDPVKAVEGIKDGASVMLGGFGLCGIPENLIGALKTKGVKDLKIISSNVGVDDFGLGILLASKQVRRVVCSYLGENKLCEQLYLAGKLELEMTPQ

SEQ ID NO: 2687 - protein, 144 aa, Rattus norvegicus
WAFSRRVSAHRPQPTLPHHLIRHYPTTRCGKVKFYTDPVKAVEGIKDGASVMLGGFGLCGIPENLIGALKTKGVKDLKIISSNVGVDDFGLGILLASKQVRRVVCSYLGENKLCEQLYLAGKLELEMTPQGTLAERIRAGGTGV

SEQ ID NO: 2688 - protein, 351 aa, Danio rerio
MAAPLKVCIVGSGNWGSAIARIIGSNAQKLQCFATTVKMWVYEEMVNGKKLSEIINTEHENVKYLPGYKLPENVVAVPQLRDAADGADLLVFVVPHQFIRKLCDEMMGCVSERARGITLIKGIDEGPEGLKLISDIIREKMGIDVSVLMGANIANEVAAEKFCESTIGSKVLENGLLFKDLLQTPNFRITVVDDADTVELCGALKNIVAVGAGFCDGLQCGDNTKAAVIRLGLMEMIAFAKLFSKDDSVSSATFLESCGVADLITTCYGGRNRRVAEAFAKTGKSIEELEKEMLNGQKLQGPLTSAEVYHILKQKGLVEKFPLFTAVYQICFEDKPVRDMITCLQSHPEHL

SEQ ID NO: 2689 - protein, 304 aa, Gallus gallus
MEAFSGTPVVVAVAAVAATVLLLLLLRGAGRRPGRPVTLRDPQAKYPLPLVGKEEISHDTKKFRFGLPSPDHVLGLPVGQHVYLSAKINGNLVIRAYTPVSSDETKGYVDLIIKVYYKNVNPKFPEGGKMSQYLDSMKIGDVIDFRGPNGLLVYKGSGTFMIKPDKKSEAQRKFAKHLGVIAGGTGITPMLQLIRHITSDPKDSTKCYLLFANQTEKDILLRAELEDIAKRHPDQVRLWYTLDRPPQDWKYSSGFVTADMIKTHLPPPGGETLILMCGPPPMIQFACQPNLDKLGYPKSSTFSY

SEQ ID NO: 2690 - protein, 727 aa, Gallus gallus
MAAEGLAGLLPAQTQLEYALLDADTPQEKENLVYQYLKKMDSRERDLTVPELSRDLQWLNTEGPISLHKDLCGKVVVLDFFTYCCINCLHLLPDLHELEHQYSDKDGLVIIGVHSAKFPNEKVLDSIKSAVLRYNIVHPVVNDADATLWHELEVSCWPTLVILGPRGNMLFSLVGEGHKEKLFLFTSITLKFYKERGQIKDNSIGIKLYKDSLPPSPLLFPGKVTVDKSGERLVIADTGHHRILVTLKNGQILHTIGGPNSGRKDGRFSEAAFNSPQGVAIKNNVIYVADTENHLIRKIDLELEIVTTVAGIGIQGVDKEGGAKGEEQPISSPWDVVFGNSVSGTQEDDVLWIAMAGIHQVWALMLEGGKLPKGSDLKKGVCLRFAGSGNEENRNNAYPHKAGFAQPSGLSLASEEPWNCLFVADSESSTVRMISLKDGAVKHLVGGERDPLNLFAFGDVDGAGINAKLQHPLGITWDKKRKLLYVADSYNHKIKVVDPKMKNCATLAGTGEASNVVGSSFTQSTFNEPGGLCIEENGRLVYVADTNNHQIKVLDLETKILSMLPILNPETCDVTDNLSVQKDQIANLPKLPKSAPNIQLPSLSAAPGQTIQFLLKLTLPPDSKLNEEAPNAWFITAEDNNTWLLQGQCLSGEIKDVSCQTVIPFQLPRVCLSAEAVLAIKACLYYCSKDSSACMMKGISFNQPLQIGSTNQGRLTQVELTHSFITN

SEQ ID NO: 2691 - protein, 953 aa, Gallus gallus
MTAAENVCYTLINVPMDSEPPSEISLKNDLEKGDVKLKTEALKKVIIMILNGEKLPGLLMTIIRFVLPLQDHTIKKLLLVFWEIVPKTTPDGRLLQEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLVELKEHPSHERVLQDLVMDILRVLSTPDLEVRKKTLQLALDLVSSRNVEELVIVLKKEVIKTNNVTEHEDTDKYRQLLVRTLHSCSVRFPDMAANVIPVLMEFLSDNNEAAAADVLEFVREAIQRFDNLRPLIVEKMLEVFHAIKSVKIYRGALWILGEYCSTKEDIQSVMTEVRRSLGEIPIVESEIKKEAGELKPEEEVTVGPVQKLVTEMGTYATQSALSSSRPTKKEEDRPPLRGFLLDGDFFVAASLATTLTKIALRYVSLVQEKKKQNSFIAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMSSKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPASCTDAEFRQMWAEFEWENKVTVNTNIIDLNEYLQHILKSTNMKCLTPEKALSGYCGFMAANLYARSIFGEDALANVSIEKPIHLGPEAPVTGHIRIRAKSQGMALSLGDKINLSQKKTSL

SEQ ID NO: 2692 - protein, 32 aa, Gallus gallus; identical to SEQ ID NO: 2646

SEQ ID NO: 2693 - protein, 153 aa, Gallus gallus
LLLAACFWVIFMFMVASKFITLTFKDPDGYGAKQEPLILTAVTKVEEARVPEEKHWTKEFQPTGKAFTGNLLHHPLVHMERLELLRNVCRDTALRNLSHTAVSKFVLDRIFVCDKHKILFCQTPKVGNTQWKKVLIVLNGAYSSIDEIPESIV

SEQ ID NO: 2694 - protein, 460 aa, Gallus gallus
MDILFRIRGGLDLAFQLATTDEASAKSVLKYVFSDLANKLSSDVLVLRICNSSVYVWPNNGINTVPELTDDSACKEIKRFVHFDQDDETRRKLGKKKDKKLQDMVINIDLMLEMTSSSDALAPVIERENKEHHYINMTLPVDVVVSVSPDETWGKVQNLLVKAIHKQLTDMERCIMKYMKGTSIVVPEQFHFMLPGKNHLVTISYPTGISDDQLESYRKELHGLFNLPCDRPYFKRANAYHFPDEPYKDGYLKNPHLHLNSPGPESGVVYLVHGTYSYHHYMQDRTDDSGWGCAYRSLQTICSWFKQQGYVDAPIPTHKEIQQALVDAGDKPAAFVGSRQWIGSVEVQLVLNQLFGITSKILFVSQGSELALQGRELANHFKTEGTPVMIGGGVLAHTILGVAWNEMTGQIKYLILDPHYTGGEDLHVILDKGWCAWKGPDFWSKDAYYNLCLPQRPKTI

SEQ ID NO: 2695 - protein, 186 aa, Gallus gallus
MAGHRLVLVLGDLHIPHRCNSLPAKFKKLLVPGKIQHILCTGNLCTKDTYDYLKTLAGDVHVVRGDFDENLNYPEQKVVTVGQFKIGLIHGHQVIPWGDMASLALLQRQFDVDILISGHTHKFEAFEHENKFYINPGSATGAYHALENNIIPSFVLMDIQASTVVTYVYQLIGDDVKVERIEYKKS

SEQ ID NO: 2696 - protein, 85 aa, Gallus gallus
CNSLPAKFKKLLVPGKIQHILCTGNLCTKDTYDYLKTLAGDVHVVRGDFDENLNYPEQKVVTVGQFKIGLIHGHQVIPWGDMASL

SEQ ID NO: 2697 - protein, 87 aa, Gallus gallus
CNSLPAKFKKLLVPGKIQHILCTGNLCTKDTYDYLKTLAGDVHVVRGDFDENLNYPEQKVVTVGQFKIGLIHGHQVIPWGDMASLAL

SEQ ID NO: 2698 - protein, 1168 aa, Gallus gallus
MNRKKGDKGFESPRPYKLTHQVVCINNINFQRKSVVGYVELTIFPTVANLNRIKLNSKQCRIYRVRVNDLEAAFIYNDPTLEVCHHESKQRNLNYFSNAYAAAVSAVDPDAGNGELCIKVPSELWKHVDELKVLKVHINFSLDQPKGGLHFVVPNMEGSMAERGAHVFSCGYQNSTRFWFPCVDSYSELCTWKLEYTVDAAMVAVSNGDLVETVYTHDMRKKTFHYMLAIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQALAQQFFGCFISRMSWSDEWVLKGISGYIYGLWMKKTFGVNEYRHWIKQELDQIVAYELKTGGVLLHPIFGGGKEKDNPASHLHFSIKHPHTLSWEYYTMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQSDFMWQYQLRYERDVVAQEEAILALEKFPTPASRLALTDILEQEQCFYRVRMLACFCLAKIANSMVSTWTGPPAMKSLFTRMFCCKTCPNIVKTNNFMNFQSYFLQKTMPVAMALLRDVHNLCPKEVLMFILDLIKYNDNRKNKFSDNYYRAELIDALANSVTPAVSVNNEVRTLDNLNPDVRLILEEITRFLNMEKLLPSYRHTITVSCLKAIRVLQKNGHVPSDPALFKSYAEYGHFVDVRIAALEAVVDYTKVDRSYEELQWLLTMVQNDPVPYIRHKILDMLTKNPPFTKNMESPLCNEALVDQLWKLMNSGTSHDWRLRCGAVDLYFTLFGLSRPSCLPLPELGLVLNLKEKKAVLNPTIIPESVANNQEPVNTTNNHGQPVVFQNTEDDHLIKETASSISGHQQGVKRKADMPLGSPLEPGQILEKNEDSKVKLKIRFSNSQEEEEIDMDTVHDSQAFIYHHLNMLERPSTPGKEQSSGEVTMHPVSAAPLSVFSKESNSSKHSDHHHHHHHEHKKKKKKTLQVWIRP

SEQ ID NO: 2699 - protein, 158 aa, Gallus gallus
VDAFSKQVFDSKESLSTAAECVKVAKEHCKQLSDIGLDLTFIIHALLVKDIKGALQSYKDIIIEATKHRNSEEMWRRMNLMTPEALGKLREEMKSCGVGSFDQYTGDDCWVNLSYTVVAFTKQTMAFLEEALKLYFPELHMVLLESLVEIILVAVQHV

SEQ ID NO: 2700 - protein, 137 aa, Gallus gallus
VKVAKEHCKQLSDIGLDLTFIIHALLVKDIKGALQSYKDIIIEATKHRNSEEMWRRMNLMTPEALGKLREEMKSCGVGSFDQYTGDDCWVNLSYTVVAFTKQTMAFLEEALKLYFPELHMVLLESLVEIILVAVQHV

SEQ ID NO: 2701 - protein, 374 aa, Gallus gallus
MSVPAFIDITEEDQAAELRAYLKSKGAEISEENSEGGLHVDLAQIIEVCDVCLKEDDKDVESVMNSVVSLLLILEPDKQEALIESLCEKLVKFREGERPSLRLQLLSNLFHGMDKNTPVRYTVYCSLLKVASSCGAIQYIPTELDQVRKWISDWNLSTDKKHTLLRLLYDVLVDCKKSDTAAKVMVELLGSYTEDNASQARVDAHRCIVRALKDPNTFLFDHLLALKPVKFLEGELIHDLLTIFVSAKLVSYVKFYQNNKDFIDSLGLLHEQNMAKMRLLTFMGMAVENKEISFDTMQQELQIGADDVEAFVIDAVKTKMVYCKIDQTQRKVVVSHSTHRTFGKQQWQQLYDTLNTWKQNLNQVKNSLLSLSDT

SEQ ID NO: 2702 - protein, 184 aa, Gallus gallus
KLLIKEVLNPFYVFQLFSVCLWFAEDYMEYAAAIIIMSPLSISLTVYDLRQQSVKLQRLVESHNSIMVTGRNKEGFQELESHHLVPGDMVVLKEGKALLPCDAILISGQCIVNESMLTGESIPVTKTQLPQADNLKPWKMHCAEDYKKHVLFCGTEVIQTKGDDRGVVKAVVLQTGFNTAKGDL

SEQ ID NO: 2703 - protein, 134 aa, Gallus gallus
HHLVPGDMVVLKEGKALLPCDAILISGQCIVNESMLTGESIPVTKTQLPQADNLKPWKMHCAEDYKKHVLFCGTEVIQTKGDDRGVVKAVVLQTGFNTAKGDLVRSILYPKPMNFRLYRDALRFLMCLIAFAAI

SEQ ID NO: 2704 - protein, 308 aa, Gallus gallus
MTPRKKLEGLVAATVTPMTPDGRINLSVIHQYVDYLVSEQNVKNIFVNGTTGEGLSLSIQERKQLAEEWMCQGKGKLDHVIIHVGALSLLESQELARHAAAIGASGIAVIAPSFFKPTNKDELLGFLQKVASEAPTVPFYYYHIPAMTGVKIRVEELLDGIREQIPTFQGVKFSDTDLLDLAQCINKKEREQFVFLYGVDEQLLSALAIGANGAVGSTYNYLGRKTNLMLQAFAKPDLALARKYQFLTGEFLSFVIKLGFGVAQTKAVMTSISGIPMGPPRLPLVGASEEFIAKAKAKLESIVWPDGD

SEQ ID NO: 2705 - protein, 992 aa, Gallus gallus
MADPSNAALRSGLNNRYRVLEVRVVRGEGRDPEKHLAVSSDPSLGDTELCVLQNGWESVPVVPGDIVHLEGDCSSGTWVINEQSGYLILYPDLLLSGTTISSSIRCMRKAVLSERFRGSECGSRQTLVGTILHEIFQQSVTNNLSPEKVEELAKKIVYGQKYLKEMYHLKLKQTEIMQEIEEYLPSFFKWTEDFVRNPANQNKMQLKLPSENKTGDCSSTVEIVDILDIEENIWSPRFGLKGKIDVTARVKIHRQGGIQSRIMPLELKSGKESNSVEHRSQVILYTLLNLERRVDPEAGFLLYLKTGTMYPVTGTRMDRRELIKLRNQVAFYLMHSTYKSAVGRQQSQLAALPPLIDDSQACKYCSQIHNCFLYSRAVEERMASVSFPPALIPIIEKETQHLKPSHLEYFSLWYLMLTLEMQSGDSKKGYKNIWMIPSLEREKAGDCVGNMIRVDQVQEVSEGQYLHSFQRKNGAVPGANLLVGDRVVVSGEENGLLGLATGYVREISATKISCLLGRNLSKLPESTTFRLDHEEGDCSIGVPFENLSKLMKDSPVSEKLRNLIIDFHKPRFIQHLSTVLPPEAKEAVASILKGLNKPQKQAMKQVLLSRDYTLIVGMPGTGKTTTICALVRILSACGFSVLLTSFTHTAVDNILLKLAKFKVGFLRLGRAQKVHPDIRKFTEEEICRSKSIKSVTDLEELYNSQPVVATACMGINHPIFVQKQFDFCIVDEASQISQPICLGPLFCSKRFVLVGDHQQLPPLVQNSEARDLGMSESLFKRLEQNQNAVVQLTVQYRMNSKIMSLSNKLVYEGKLECGSEKVSNATANLPNLKMLKLEFADASKTWLKEVLEPDKPVCFLNTEKAGCRPSDIGIISPYRHQLKVITDLMARLKENRVEVNTIDKYQGRDKSIIIVSFVRNSNDENLGALLEDWRRLNVAITRAKHKLIMVGCVPSLRRYPPLEKLLCHLQSEAMIFNLPAGAHESIHKCNIL

SEQ ID NO: 2706 - protein, 755 aa, Gallus gallus
MELGKAKLLRTGLNALHQAIHPVHGIAWTDGKQVILTSLHLHNGEPKFGDSSVVGQFEHVHGLYWGPGPPDAPALLAVQHKKHITVWQLCFNAADRNKLLVSQICDISEPFPVLPQGCVWHPKKEILAVLTTRDASVLHSVHLNNCRIKADIKGSGLIHCACWTKEGNRLVVGVGSALHSYIWDDTQKTLNACTFCPIFDVGGYICAVEATLNFQIAVATELPLDKICGLNAGVAFEVPASIETESFPSQSSLCGEEEYSMDGGKKVLDAEKPMSAVTSPVDLTHILSSKPGADSSPLLHLRPKDYLTGSGQDSSHLILVTFEKKVTSTKKVSIPGILVPDIMAFDIKTQTVSVASNTCNVILVYSLTSSNLPNIQQIQLEKNEKPKGLCFLTNKLLLILVGKQKFTDPAFLPSSRSDKYMIRLMIKELIFEVAPSTSASVNGSCASVNGSLNLSNIPHDVSTDVHPLSRGLLIPDRAALQSPTSRRKLIEEIKSPGYEQSCLLNMSDLKEKKVSLNFPPAVESLNAEPLNQSASLSTTSLAFSNKPTSPKRQIETASKIPNSYKNNLLSEKEASYFSKNVEKLSGNFTQLQHHVCELTELLKAGKRNLPMYPSSQEPSFINITCQKQLSRNDSDERRSVILCEGKLRLSVVQQIFNLSLVEMQHGSSWIVLTADSEGFVPLTFTSMQEVVVRDASMKGYSARSSKTLDIISSTEGCRHSASESLDITSSLEVLRDCSSKALDGSSPSEQPSSKV

SEQ ID NO: 2707 - protein, 536 aa, Gallus gallus
MLSRSSFTSLAVGVFAVYVAHTCWVMYGIVYTRPCPSGGAAACVWPYLARRPKLQLSVYTTTRSNIGAESNIDLVLNVEDFDIESKFERTVNVSVPKKTRNNGTLYAYIFLHHAGVLPWHDGKQVHIVSPLTTYMVPKPEEINLLTGESTTQQIEAEKQTSALDEPVSHWRSRLTLNVMVEDFVFDGSSLPADVHRYMKMVQLGKTVHYLPILFIDQLSNRVKDLMVINRSTTELPLTVSYDKISLGKLRFWIHMQDAVYSLQQFGFSEKDADEVKGIFVDTNLYFLALTFFVAAFHLLFDFLAFKNDISFWKKKRSMIGMSTKAVLWRCFSTVVIFLFLLDEQTSLLVLIPAGIGAVIELWKVKKALKMTVKWQGIRPKVQFGASNDSEKKTEEYDTQAMKYLSYLLYPLCIGGAAYSLLNVKYKSWYSWLINSFVNGVYAFGFLFMLPQLFVNYKMKSVAHLPWKAFTYKAFNTFIDDIFAFIITMPTSHRLACFRDDVVFLVYLYQRWLYPVDKSRVNEYGESYEEKPKKKSS

SEQ ID NO: 2708 - protein, 59 aa, Gallus gallus
VHRYMKMVQLGKTVHYLPILFIDQLSNRVKDLMVINRSTTELPLTVSYDKISLGKLRFW

SEQ ID NO: 2709 - protein, 81 aa, Gallus gallus
MKMVQLGKTVHYLPILFIDQLSNRVKDLMVINRSTTELPLTVSYDKISLGKLRFWIHMQDAVYSLQQFGFSEKDADEVKGI

SEQ ID NO: 2710 - protein, 658 aa, Gallus gallus
MKLYCLSGHPTLPCNVLKFKSTTIMLDCGLDMTSTLNFLPLPLVQSPRLSKLPGLVLKDGSTFLDKELKECSGHVFVDSVPEFCLPETELLDLSTVDVILISNYHCMMALPYITEYTGFTGTVYATEPTVQIGRLLMEELVNSIERVPKAQSASTWKNKEVQRLLPAPLKDAVEVSMWRKCYTMPEVNAALSKIQLVGYSQKIELFGAVQVTPLSSGYALGSSNWIIQSHYEKVSYVSGSSLLTTHPQPMDQASLKNSDVLILTGLTQIPTANPDGMVGEFCSNLAMTVRNGGNVLVPCYPSGVIYDLLECLYQYIDSAGLSNVPFYFISPVANSSLEFSQIFAEWLCHNKQTKVYLPEPPFPHAELIQTNKLKHYPSIHGDFSNDFKQPCVIFTGHPSLRFGDVVHFMELWGKSSLNTVIFTEPDFSYLDALAPYQPLAMKCVYCPIDTRLNFIQVSKLLKEVQPLHVVCPEQYTQPPPSQSHRTDLMIDCQPPPMSYRRAEVLTLPYKRRYEKIEIMPELADSLVPLEIKPGISLATVSAMLHTKDNKHVLQLPPKPPQPPTSKKRKRVSDDVPECKPLKPLLSGSIPVDQFVQTLEKHGFSDVKVEDTAKGHIVLLQEAETLIQIEEDSTHIICDNDEPLRVKLRDLVLKFLQKF

SEQ ID NO: 2711 - protein, 752 aa, Gallus gallus
MASKVTDARDWYQKKIGAYDQQIWEKSVEQREIKGLRNKPKKTGHVKPDLIDVDLVRGSAFAKAKPESPWTSLTRKGIVRVVFFPFFYRWWLQVTSRVIFFWLLVLYLLQVAAVVLFCTAQSPHNIPLTEVIGPIWLMLLLGTVHCQIVSTRTPKPPPSTGVKRRRKLRKAAHLEVHREGDGSSTTDNTQEGTVQSYGTSTSYSIGAVFRDIWHAAFFLSGSKKAKNSIDKSTETDNGYVSLEGKKTGKSSEECAQAQERLCEVIKPEESGWSTTTMRETFGTPSHHKETHRTVTNLSDEVSSEEGPETGYSLRRNVERTSSDGTLRNRKSHHYKKHYPLEDTPKSGTSCSSRCSSSRQDSESTRPESETEDVWEDLLHCAECHSSCTSETDVESPQMNPCVKKEYRDDPFHQSHLPWIHSLNPGLEKISAIVWEGNDCKKADMSVLEISGMIMNRVNSYIPGIGYQIFGNIISLILGLMPFVFRLSQAKDLEQLAAHSATELCITAFGSNGDILVLSMVVISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHMHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 2712 - protein, 188 aa, Gallus gallus
ILVLSMVVISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHMHEIFLDCHYNWELVIWCISLTLFLLRFVTLGSETSKKYSNTSILLTEQINLYLKMEKKPNKKEELTLVNNVLKLATK

SEQ ID NO: 2713 - protein, 108 aa, Gallus gallus
GPQRSVDVIVSSAFLLTISVVFICCAQLLHMHEIFLDCHYNWELVIWCISLTLFLLRFVTLGSETSKKYSNTSILLTEQINLYLKMEKKPNKKEELTLVNNVLKLATK

SEQ ID NO: 2714 - protein, 723 aa, Gallus gallus
MAALCEAFTLCGLGPAGGVGLGSGLLALEPGADPDHVLLTDRGRTTTLFKVSDQKPLGCWSVKHGQIITCPVVCNFETHEYIAVHDNKVLRIWKDEDVNLDKVFKATLSAEVYRIHSLPHAEPLVLFKGGGVRTLDVLLEAPQQEIENVISDEVIKWSEAFLESRQPVLIFVTEKDGDFFVYVQKPKMRSLHKYKLEQQELCNPLSFTAYIKKQIITLLCLYSSDSVYKVLIPLQQSSEEEEQTSSKSLLLNLSISGSVLKGTSFVVLDKDHVAVLGSLAASGEESKECLTIWNTKFQTLQASKELPLGTSGQLWCYGEKFFFTHGKVLTVVIYKCETSSLAAAVGKLKDSQTSDLSSFVNWNTLGDEELLVSLQSQQSVALKSESKMTLRSKKSAVANIQPDTSTVGQFLLSIKDASTAAVEDQLRQLLSKAQMPDFQATIGCIISALINRCKTDPKFYPRNFLVQMIQKGELSYSLCPDLMAVALEKKDVHLLQICLQRFPDIPEEITYACLKVFLSISDDYLERTDVNLESVISYIDIEPNNKEVKTEVVENGFNTELEEDGCDVTGMKETHMMDSVEFCPVGPQKAALLNAVLHSAYSETFLLPHLKDLPAQQAVLFLRYLHYLYVKCSEKINTTLPGILSPTISQIMDWMCLLLDAHFTVMVMLPEAKGLLSSMHRFVRAQVRLYSELNKIEGSLQELQRIKCQKHSQAYSIEVLELI

SEQ ID NO: 2715 - protein, 49 aa, Gallus gallus
MVLFQKPFSSGKVVTKHQWIKIFKHAVVGCIISLLWFFGLTLCGPLRTL

SEQ ID NO: 2716 - protein, 100 aa, Gallus gallus
QKPFSSGKVVTKHQWIKIFKHAVVGCIISLLWFFGLTLCGPLRTLLLFEHSDVVVLSLLSVLFTSSGGGPAKTRGAAFFIIAVICLLLFDNDDLMAKIAE

SEQ ID NO: 2717 - protein, 619 aa, Gallus gallus
MKKDVRILLVGEPRVGKTSLIMSLVSEEFPEEVPPRAEEITIPADVTPERVPTHIVDYSEAEQNDEQLYHEISQANVICIVYAVNNKNSIDKVTSRWIPLINERTDKDSRLPLILVGNKSDLVEYSSMETILPIMNQYTEIETCVECSAKNLKNRSELFYYAQKAVLHPTGPLYCPEEKEMKPACIKALTRIFRISDQDNDGTLNDAELNFFQRICFNTPLAPQALEDVKNVVRKNVSDGVADNGLTLKGFLFLHTLFIQRGRHETTWTVLRRFGYDDDLELTPEYLFPLLKIPPDCTTELNHHAYLFLQSIFDKHDLDRDCALSPDELKDLFKVFPYMPWGPDVNNTVCTNGKGGWITYQGFLSQWTLTTYLDVQRCLEYLGYLGYSILAEQESQASAITVTRDKKIDLQKKQTQRNVFRCNVVGMKGCGKSGVLQALLGRNLMRQRQIRAEHKSYYAINTVYVYGQEKYLLLHDVSDSEFLTDAETICDVVCLVYDVSNPKSFEYCVRIFKQHFMDSRIPCLVVAAKSDLHEVRQEYSISPAEFCKKHKMPPPQAFTCNTVDMPSKDIFVKLTTMAMYPHVTQADLKSSTFWLRASFGATVFAFLGFAMYKALIKQR

SEQ ID NO: 2718 - protein, 334 aa, Gallus gallus
MGEPIRVLVTGAAGQIAYSLLYSIAKGDVFGKEQPLVLVLLDITPMMTVLEGVVMELQDCALPLLREVIPTDKEEVAFKDLDIAILVGSMPRREGMERKDLLKANVKIFKSQGAALDKYAKKTVKVVVVGNPANTNCLIASKSAPSIPKENFSCLTRLDHNRAKSQIALKLGVTSNDVKNVIIWGNHSSTQYPDVNHAKVNVKGKEVGVYEAIKDDSWLKGDFILTVQQRGAAVIKARKLSSAMSAAKAICDHVRDIWFGTPAGEFVSMGVISDGNSYGVPEDLLYSFPVVIKDKTWKFVEGLPINDFSREKMDLTAKELTEEKETAVEFLSSA

SEQ ID NO: 2719 - protein, 513 aa, Gallus gallus
MSIEIESSDVIRLIMQYLKENSLHRALATLQEETTVSLNTVDSIESFVADINSGHWDTVLQAIQSLKLPDKTLIDLYEQVVLELIELRELGAARSLLRQTDPMIMLKQTQPERYIHLENLLARSYFDPREAYPDGSSKEKRRAAIAQALAGEVSVVPPSRLMALLGQALKWQQHQGLLPPGMTIDLFRGKAAVKDVEEEKFPTQLSRHIKFGQKSHVECARFSPDGQYLVTGSVDGFIEVWNFTTGKIRKDLKYQAQDNFMMMDDAVLCMCFSRDTEMLATGAQDGKIKVWKIQSGQCLRRFERAHSKGVTCLSFSKDSSQILSASFDQTIRIHGLKSGKTLKEFRGHSSFVNEATFTQDGHYIISASSDGTVKVWNVKTTECSNTFKSLGSTAGTDITVNSVILLPKNPEHFVVCNRSNTVVIMNMQGQIVRSFSSGKREGGDFVCCALSPRGEWIYCVGEDFVLYCFSTVTGKLERTLTVHEKDVIGIAHHPHQNLIATYSEDGLLKLWKP

SEQ ID NO: 2720 - protein, 711 aa, Listeria monocytogenes
MAEKTVYRVDGLSCTNCAAKFERNVKEIEGVTEAIVNFGASKITVTGEASIQQVEQAGAFEHLKIIPEKESFTDPEHFTDHQSFIRKNWRLLLSGLFIAVGYASQIMNGEDFYLTNALFIFAIFIGGYSLFKEGFKNLLKFEFTMETLMTIAIIGAAFIGEWAEGSIVVILFAVSEALERYSMDKARQSIRSLMDIAPKEALVRRSGTDRMVHVDDIQIGDIMIIKPGQKIAMDGHVVKGYSAVNQAAITGESIPVEKNIDDSVFAGTLNEEGLLEVAVTKRVEDTTISKIIHLVEEAQGERAPAQAFVDTFAKYYTPAIIVIAALIATVPPLLFGGNWETWVYQGLSVLVVGCPCALVVSTPVAIVTAIGNAAKNGVLVKGGVYLEEIGGLKAIAFDKTGTLTKGVPVVTDYIELTEATNIQHNKNYIIMAALEQLSQHPLASAIIKYGETREMDLTSINVNDFTSITGKGIRGTVDGNTYYVGSPVLFKELLASQFTDSIHRQVSDLQLKGKTAMLFGTNQKLISIVAVADEVRSSSQHVIKRLHELGIEKTIMLTGDNQATAQAIGQQVGVSEIEGELMPQDKLDYIKQLKINFGKVAMVGDGINDAPALAAATVGIAMGGAGTDTAIETADVALMGDDLQKLPFTVKLSRKTLQIIKQNITFSLVIKLIALLLVIPGWLTLWIAIMADMGATLLVTLNGLRLMKVKD

SEQ ID NO: 2721 - protein, 200 aa, Cavia porcellus
PVKHDNEKSQYLKKSINVKNVVYKIKSIKSSVRTHYIEMHIIVEKNLYKHMGGNTATVTEKIFQLVGLMNAFFSTLNLTVILASLELWIDENKIPTTGDVNELLHAFQKWKKSYLVLRPHDVAFLLVYRESPSYIGAIFQGMICNTSYGGGIALHSKTITLDSFGVILVQLLSVSMGIAYDNADLCRCRGAICLMSPEAV

SEQ ID NO: 2722 - protein, 67 aa, Cavia porcellus
VYKIKSIKSSVRTHYIEMHIIVEKNLYKHMGGNTATVTEKIFQLVGLMNAFFSTLNLTVILASLELW

SEQ ID NO: 2723 - protein, 247 aa, Cricetulus griseus
MAGEADGPFKRVLVPVLLPEKCYDQLFVHWDFLHVPCLKILLSKGLGLGIVAGSLLVKLPQIFKILGAKSAEGLSLQSVMLELVALTGTVIYSITNNFPFSSWGEALFLTLQTITICLLVLHYRGDTVKGVALLACYATLLLALLSPLTPLAVVTMLQASNVPAVVVGKLLQAATNYHNGHTGQLSAITVFMLFGGSLARIFTSVQETGDPLMAGVFVVSSLCNGLIAAQVLFYWNAKPPHKHKKEQ

SEQ ID NO: 2724 - protein, 121 aa, Mus musculus
HTGAVFSVDYSDELDILVSGSADFAVKVWALSAGTCLNTLTGHTEWVTKVVLQKCKVKSLLHSPGDYILLSADKYEIKIWPIGREINCKCLKTLSVSEDRSICLQPRLHFDGKYIVCSSAL

SEQ ID NO: 2725 - protein, 134 aa, Mus musculus
ADFAVKVWALSAGTCLNTLTGHTEWVTKVVLQKCKVKSLLHSPGDYILLSADKYEIKIWPIGREINCKCLKTLSVSEDRSICLQPRLHFDGKYIVCSSALGLYQWDFASYDILRVIKTPEVANLALLGFGDVFA

SEQ ID NO: 2726 - protein, 159 aa, Mus musculus
LWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVA

SEQ ID NO: 2727 - protein, 66 aa, Mus musculus
VKKVRDLKETDIKHLRKLKHPNIITFKGVCTQAPCYCILMEFCAQGQLYEVLRAGRPVTPSLLVDW

SEQ ID NO: 2728 - protein, 81 aa, Mus musculus
IHEGCLLWKTATGRFKDVLLLLMTDVLVFLQEKDQKYIFTSLDKPSVVSLQNLIVRDIANQAKGMFLISSGPPEMYEVHAA

SEQ ID NO: 2729 - protein, 405 aa, Macaca fascicularis
MQEKDASSQGFLPHFQHFATQAIHVGQEPEQWTSRAVVPLISLSTTFKQAAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPVLKMIDIEACAHIVHKRGDIILVVDNTFMSPYFQRPLALGADICMCSATKYMNGHSDVVMGLVSVNCERLHNRLRFLQNSLGAVPSPLDCYLCNRGLKTLHVRMEKHFKNGMAVAQFLESNPGVEKVIYPGLPSHPQHELAKRQCTGCTGMITFYIKGTLQHAEIFLKNLKLFTLAESLGGFESLVELPAIMTHASVPKNDRDVLGISDTLIRLSVGLEDEKDLLEDLDQALKAAHPPSGSHD

SEQ ID NO: 2730 - protein, 30 aa, Mus musculus
TFDLKLVWVKPGQDKCVLHILTPEEEISFC

SEQ ID NO: 2731 - protein, 96 aa, Mus musculus
VQKHLWPLKDLKLTSNQRYSLVRDKCFLTATECLQKIITTVHPREKLEVLEKTYGEIEATVSRVLGCKYKLPMDDLLPLLIYVVSRARIQHLGAEI

SEQ ID NO: 2732 - protein, 30 aa, Mus musculus; identical to SEQ ID NO: 2730

SEQ ID NO: 2733 - protein, 96 aa, Mus musculus; identical to SEQ ID NO: 2731

SEQ ID NO: 2734 - protein, 95 aa, Mus musculus
DKKRHLGNDFVSIIYNDSGEDFKLGTIKQGQFNFVHVIITPLDYKCNLLTLQCRKDGPACKCEWWRQPGEIVVWALPVVMELTVTILLCHLQMAS

SEQ ID NO: 2735 - protein, 85 aa, Mus musculus
GEELQSFVGAVIVGTYNVVVVIVLTKLLVAMLHKSFQLIANHEDKEWKFARAKLWLSYFDDKCTLPPPFNIIPSPKTICYMISSL

SEQ ID NO: 2736 - protein, 73 aa, Mus musculus; identical to SEQ ID NO: 252

SEQ ID NO: 2737 - protein, 85 aa, Mus musculus; identical to SEQ ID NO: 2735

SEQ ID NO: 2738 - protein, 73 aa, Mus musculus; identical to SEQ ID NO: 252

SEQ ID NO: 2739 - protein, 587 aa, Mus musculus
MFAKAFRVKSNTAIKGSDRRKLRADVTAAFPALGTDQISELIPGKEELNVVKLYVHKGDSVTVYTSGGNPILFELEKNLYPTVYTLWAYPDILPTFITWPLVLEKLVGGADLMLPGVVVPPTGLPQVQQGDLCAIALVGNRAPVAIGVAAMSTAQMLASGLKGKGVSVLHTYQDHLWRSGDKSSPPAIAPLDPTDSCEEKVHLGLQGNLKSLTLDGEEENGQVPLREASEDTSSRAPSQDSLDGKPLQEQMDDLLLRCFLHALKSRVKKADLPLLTSTLLGSHMFSCCPEGQQLDIKKSSYKKLSKFLQHMQQEQIVQVKELSKGVESIVAVDWRHPRITSFVIPEPSLTSQTVQEVSREQPYLPPDIKSLYCVPANMTQLFLESGHKKGSTLEGSEVRKIITDYAKRNRLVDADNRNLVKLDPILCDCILEKNEQHLVTKLPWDCLLTRCLKNMQPAYQVTFPGQEPILKKGKLCPIDITLALKTYNKKVTVVRNLETYGLDPCSVAAILQQRCQASTIVSPAPGAKDSLQVQVQGNQIHHLGQLLLEENTGTLHLPAQYPHPHVQNKPEIPHLSCCGLPASHDSI

SEQ ID NO: 2740 - protein, 314 aa, Mus musculus
MAFVTRQFLRSMSSSSSASAAAKKILIKHVTVIGGGLMGAGIAQVAAATGHTVVLVDQTEDILAKSKKGIEESLKRMAKKKFTENPKAGDEFVEKTLSCLSTSTDAASVVHSTDLVVEAIVENLKLKNELFQRLDKFAAEHTIFASNTSSLQITNIANATTRQDRFAGLHFFNPVPMMKLVEVIKTPMTSQKTFESLVDFCKTLGKHPVSCKDTPGFIVNRLLVPYLIEAVRLHERGDASKEDIDTAMKLGAGYPMGPFELLDYVGLDTTKFILDGWHEMEPENPLFQPSPSMNNLVAQKKLGKKTGEGFYKYK

SEQ ID NO: 2741 - protein, 120 aa, Mus musculus
KFSELKNATKRVKQETFTLTVPIGVRKFCVKVLPRLESRINKAEWSEEQCLLITTEQYFTVTNLSILVISMLLFCGILVCLVLQWYIRHPGKLPTVLVFKKPHDFFPANPLCPETPDAIH

SEQ ID NO: 2742 - protein, 142 aa, Mus musculus
KFSELKNATKRVKQETFTLTVPIGVRKFCVKVLPRLESRINKAEWSEEQCLLITTEQYFTVTNLSILVISMLLFCGILVCLVLQWYIRHPGKLPTVLVFKKPHDFFPANPLCPETPDAIHIVDLEVFPKVSLELRDSVLHGS

SEQ ID NO: 2743 - protein, 303 aa, Mus musculus
MWPLAAALLLGSCCCGSAQLLFSNVNSIEFTSCNETVVIPCIVRNVEAQSTEEMFVKWKLNKSYIFIYDGNKNSTTTDQNFTSAKISVSDLINGIASLKMDKRDAMVGNYTCEVTELSREGKTVIELKNRTVSWFSPNEKILIVIFPILAILLFWGKFGILTLKYKSSHTNKRIILLLVAGLVLTVIVVVGAILLIPGEKPVKNASGLGLIVISTGILILLQYNVFMTAFGMTSFTIAILITQVLGYVLALVGLCLCIMACEPVHGPLLISGLGIIALAELLGLVYMKFVASNQRTIQPPRNR

SEQ ID NO: 2744 - protein, 324 aa, Mus musculus
MWPLAAALLLGSCCCGSAQLLFSNVNSIEFTSCNETVVIPCIVRNVEAQSTEEMFVKWKLNKSYIFIYDGNKNSTTTDQNFTSAKISVSDLINGIASLKMDKRDAMVGNYTCEVTELSREGKTVIELKNRTAFNTDQGSACSYEEEKGGCKLVSWFSPNEKILIVIFPILAILLFWGKFGILTLKYKSSHTNKRIILLLVAGLVLTVIVVVGAILLIPGEKPVKNASGLGLIVISTGILILLQYNVFMTAFGMTSFTIAILITQVLGYVLALVGLCLCIMACEPVHGPLLISGLGIIALAELLGLVYMKFVASNQRTIQPPRNR

SEQ ID NO: 2745 - protein, 145 aa, Mus musculus
TPRAPQLVGQFIARAVGDGILCNTYIDSYKGTVDCVQARAALDKATVLLSMSKGGKRKDSVWGSGGGQQPVNHLVKEIDMLLKEYLLSGDISEAEHCLKELEVPHFHHELVYEAIVMVLESTGESAFKMILDLLKSLWKSSTITI

SEQ ID NO: 2746 - protein, 1495 aa, Mus musculus
MRRNQLPTPAFLLLFLLLPRDATTATAKPQYVVLVPSEVYSGVPEKACVSLNHVNETVMLSLTLEYAMQQTKLLTDQAVDKDSFYCSPFTISGSPLPYTFITVEIKGPTQRFIKKKSIQIIKAESPVFVQTDKPIYKPGQIVKFRVVSVDISFRPLNETFPVVYIETPKRNRIFQWQNIHLAGGLHQLSFPLSVEPALGIYKVVVQKDSGKKIEHSFEVKEYVLPKFEVIIKMQKTMAFLEEELPITACGVYTYGKPVPGLVTLRVCRKYSRYRSTCHNQNSMSICEEFSQQADDKGCFRQVVKTKVFQLRQKGHDMKIEVEAKIKEEGTGIELTGIGSCEIANALSKLKFTKVNTNYRPGLPFSGQVLLVDEKGKPIPNKNITSVVSPLGYLSIFTTDEHGLANISIDTSNFTAPFLRVVVTYKQNHVCYDNWWLDEFHTQADHSATLVFSPSQSYIQLELVFGTLACGQTQEIRIHYLLNEDIMKNEKDLTFYYLIKARGSIFNLGSHVLSLEQGNMKGVFSLPIQVEPGMAPEAQLLIYAILPNEELVADAQNFEIEKCFANKVNLSFPSAQSLPASDTHLKVKAAPLSLCALTAVDQSVLLLKPEAKLSPQSIYNLLPGKTVQGAFFGVPVYKDHENCISGEDITHNGIVYTPKHSLGDNDAHSIFQSVGINIFTNSKIHKPRFCQEFQHYPAMGGVAPQALAVAASGPGSSFRAMGVPMMGLDYSDEINQVVEVRETVRKYFPETWIWDLVPLDVSGDGELAVKVPDTITEWKASAFCLSGTTGLGLSSTISLQAFQPFFLELTLPYSVVRGEAFTLKATVLNYMSHCIQIRVDLEISPDFLAVPVGGHENSHCICGNERKTVSWAVTPKSLGEVNFTATAEALQSPELCGNKLTEVPALVHKDTVVKSVIVEPEGIEKEQTYNTLLCPQDTELQDNWSLELPPNVVEGSARATHSVLGDILGSAMQNLQNLLQMPYGCGEQNMVLFVPNIYVLNYLNETQQLTEAIKSKAINYLISGYQRQLNYQHSDGSYSTFGNHGGGNTPGNTWLTAFVLKAFAQAQSHIFIEKTHITNAFNWLSMKQKENGCFQQSGYLLNNAMKGGVDDEVTLSAYITIALLEMPLPVTHSAVRNALFCLETAWASISQSQESHVYTKALLAYAFALAGNKAKRSELLESLNKDAVKEEDSLHWQRPGDVQKVKALSFYQPRAPSAEVEMTAYVLLAYLTSESSRPTRDLSSSDLSTASKIVKWISKQQNSHGGFSSTQDTVVALQALSKYGAATFTRSQKEVLVTIESSGTFSKTFHVNSGNRLLLQEVRLPDLPGNYVTKGSGSGCVYLQTSLKYNILPVADGKAPFALQVNTLPLNFDKAGDHRTFQIRINVSYTGERPSSNMVIVDVKMVSGFIPMKPSVKKLQDQPNIQRTEVNTNHVLIYIEKLTNQTLGFSFAVEQDIPVKNLKPAPIKVYDYYETDEFTVEEYSAPFSDGSEQGNA

SEQ ID NO: 2747 - protein, 1086 aa, Mus musculus
MAHLLKTVVAGCSCPFLSNLGSSKVLPGKRDFVRTLRTHQALWCKSPVKPGIPYKQLTVGVPKEIFQNEKRVALSPAGVQALVKQGFNVVVESGAGEASKFPDDLYRAAGAQIQGMKEVLASDLVVKVRAPMVNPTLGAHEADFLKPSGTLISFIYPAQNPDLLNKLSERKTTVLAMDQVPRVTIAQGYDALSSMANISGYKAVVLAANHFGRFFTGQITAAGKVPPAKILIVGGGVAGLASAGAAKSMGAVVRGFDTRAAALEQFKSLGAEPLEVDLKESGEGQGGYAKEMSKEFIEAEMKLFAQQCKEVDILISTALIPGKKAPVLFSKEMIESMKEGSVVVDLAAEAGGNFETTKPGELYVHKGITHIGYTDLPSRMATQASTLYSNNITKLLKAISPDKDNFHFEVKDDFDFGTMSHVIRGTVVMKDGKVIFPAPTPKNIPEEAPVKPKTVAELEAEKAGTVSMYTKTLTTASVYSAGLTGMLGLGIVAPNVAFSQMVTTFGLAGIIGYHTVWGVTPALHSPLMSVTNAISGLTAVGGLALMGGHFYPSTTSQSLAALATFISSVNIAGGFLVTQRMLDMFKRPTDPPEYNYLYLLPGGTFVGGYLAALYGGYNIEEIMYLGSGLCCVGALGGLSTQGTARLGNALGMIGVAGGLAATLGGLKPDPQLLAQMSGAMAMGGTIGLTIAKRIQISDLPQLVAAFHSLVGLAAVLTCMAEYIVEYPHFAMDATSNFTKIVAYLGTYIGGVTFSGSLVAYGKLQGILKSAPLLLPGRHALNAGLLAASVGGIIPFMADPSFTTGITCLGSVSGLSTLMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAVEMIREANSIVITPGYGLCAAKAQYPIADLVKMLTEQGKKVRFGIHPVAGRMPGQLNVLLAEAGVPYDIVLEMDEINSDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 2748 - protein, 354 aa, Mus musculus
MGKLVALTLLGACLALIGERLLNFRERVSTTREIKATEPQNCHLIEGLENGSEDIDILPSGLAFISTGLKYPGMPAFAPDKPGRIFLMDLNEQNPEAQALEISGGLDQESLNPHGISTFIDKDNTAYLYVVNHPNMDSTVEIFKFEEQQRSLIHLKTLKHELLKSVNDIVVLGPEQFYATRDHYFTSYFLVLLEMILDPHWTSVVFYSPKEVKVVAQGFSSANGITVSLDQKFVYVADVTAKNIHIMKKHDNWDLTPVKVIQLGTLVDNLTVDPATGDILAGCHPNPMKLLIYNPEDPPGSEVLRIQDSLSDKPRVSTLYANNGSVLQGSTVASVYHKRMLIGTIFHKALYCDL

SEQ ID NO: 2749 - protein, 739 aa, Mus musculus
MSSENKEQHDLSPRDLPEEAFGFPSELPLETQRRSGTDLRQSETGHGRRAFRRIHMELREKPDTDIKQFVIRELQKSCQCSAAKVRDGAFDFFPVLRWLPKYDLKKNILGDVMSGLIVGILLVPQSIAYSLLAGQEPIYGLYTSFFASIIYFLFGTSRHISVGIFGILCLMIGEVVDRELHKACPDTDATSSSIAVFSSGCVVVNHTLDGLCDKSCYAIKIGSTVTFMAGVYQVAMGFFQVGFVSVYLSDALLSGFVTGASFTILTSQAKYLLGLSLPRSHGVGSVITTWIHIFRNIRNTNICDLITSLLCLLVLVPSKELNEHFKDKLKAPIPVELIVVVAATLASHFGKLNGNYNSSIAGHIPTGFMPPKAPDWSLIPNVAVDAIAISIIGFAITVSLSEMFAKKHGYTVKANQEMYAIGFCNIIPSFFHCITTSAALAKTLVKESTGCQTQLSAIVTALVLLLVLLVIAPLFYSLQKCVLGVITIVNLRGALLKFRDLPKMWRLSRMDTVIWFVTMLSSALLSTEIGLLVGVCFSMFCVILRTQKPKNSLLGLEEESETFESISTYKNLRSKSGIKVFRFIAPLYYINKECFKSALYKKALNPVLVKAAWKKAAKRKLKEEMVTFRGDPDEVSMQLSHDPLEVHTIVIDCSAIQFLDTAGIHTLKEVRRDYEAVGIQVLLAQCNPSVRDSLARGEYCKKEEETLLFYSLSEAVAFAEDSQNQKGVCVVNGLSLSGD

SEQ ID NO: 2750 - protein, 381 aa, Rattus norvegicus
MNPFSSESAWLCLTATAVLGGMLLCKAWSSGQLRSQVVCLAGLWGGACLLSLSLLCSLFLLSVSCFFLLYVSSSDQDLLPVDQKAVLVTGADSGFGHALAKHLDKLGFTVFAGVLDKEGPGAEELRKNCSERLSVLQMDVTKPEQIKDVHSEVAEKIQDKGLWAVVNNAGVLHFPIDGELIPMTVYRKCMAVNFFGAVEVTKVFLPLLRKSKGRLVNVSSMGAMIPFQMVAAYASTKAAISMFSAVIRQELAKWGVKVVTIHPGGFQTNIVGSQDSWDKMEKEILDHFSKEIQENYGQEYVHTQKLALPVMREMSNPDITPVLRDIQHAICAKNPSSFYCSGRMTYLWICFAAYSPISLLDYILKNYFTPKLMPRALRTAS

SEQ ID NO: 2751 - protein, 963 aa, Rattus norvegicus
MDSPSAGYTFEYLIETLNGSSQKKFFNVPKLGGTKYDILPYSIRVLLEAAVRNCDGFLMKKEDVINILDWKTKQSNVEVPFFPARVVLQDFTGIPAMVDFAAMREAVKTLGGDPKKVHPACPTDLTVDHSLQIDFSKCAIQNAPNPGGGDLQKAGKLSPLKVQPKKLPCRGQTTCRGSCDSGELSRNSGTFSSQIENTPVLCPFHLQPVPEPETVLKNQEVEFGRNRERLQFFKWSSGAFKNVAVIPPGTGMAHQVNLEHLSRVVFEEADLLFPDSVIGTDSHITMVNGLGILGWGVGGIETEAVMLGLPVTLTLPEVVGCELTGSSNAFVTSIDIVLGITKHLRQVGVAGKFVEFFGSGVSQLSIVDRTTIANMCPEYGAILSFFPVDNVTLRHLEHTGFDKTKLESMEEYLKAVKLFRNDENSSEPEYSQVIQINLNSIVASVSGPKRPQDRVAVTDMKSDFQACLNEKVGFKGFQVAAEKQSDTVSVRYDGSEYKLSHGSVVIAAVISCTNNCNPSVMLAAGLLAKKAVETGLRVKPYIRTSLSPGSGMVTHYLSSSGVLPYLSKLGFEIVGYGCSTCVGNTAPLSEAILNAVKQGDLVTCGVLSGNKNFEGRLCDCVRANYLASPPLVVAYAIAGTVNIDFQTEPLGTDSTGKNIYLHDIWPSREEVHQIEEEHVILSMFKALKEKVEMGNKRWNSLDAPDSVLFPWDVKSTYIRCPSFFDKLTKEPAASQPIENAHVLLYLGDSVTTDHISPAGSIARSSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLEFLPGENADSLGLSGREVFSLSFPEELFPGITLNIKTSTGKEFSVIAAFENDVEITLYKHGGLLNFVARKFL

SEQ ID NO: 2752 - protein, 512 aa, Rattus norvegicus
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 2753 - protein, 78 aa, Rattus norvegicus
ICTEFMDGGSLDVYRKIPEHVLGRIAVAVVKGLTYLWSLKILHRDVKPSNMLVNTSGQVKLCDFGVSTQLVNSIAKTY

SEQ ID NO: 2754 - protein, 146 aa, Rattus norvegicus
DTLGHGNGGTVYKAYHVPSGKILAVKVILLDITLELQKQIMSELEILYKCDSSYIIGFYGAFFVENRISICTEFMDGGSLDVYRKIPEHVLGRIAVAVVKGLTYLWSLKILHRDVKPSNMLVNTSGQVKLCDFGVSTQLVNSIAKT

SEQ ID NO: 2755 - protein, 1500 aa, Rattus norvegicus
MRRNQLPIPVFLLLLLLLPRDATAATGKPRYVVLVPSELYAGVPEKVCVHLNHLNETVTLNVTLEYGVQYSNLLIDQAVDKDSSYCSSFTISRPLSPSALIAVEIKGPTHHFIKKKSMWITKAESPVFVQTDKPIYKPGQTVKFRVVSVDISFRPVNETFPVVYIENPKRNRIFQWQNVDLPGGLHQLSFPLSVEPALGIYKVVVQKDSGKKIEHSFEVKEYVLPKFEVQVKMPKTMAFLEEELVVTACGLYTYGKPVPGLVTMKVCRKYTQSYSNCHGQHSKSICEEFSKQADEKGCFRQVVKTKVFQPRQKGYDMKIEVEAKIKEDGTGIELTGTGSCEIANTLSKLKFTKANTFYRPGLPFFGQVLLVDEKGQPIPNKNLTVQVNSVRSQFTFTTDEHGLANILIDTTNFTFSFMGIRVIYKQNNICFDNWWVDEYHTQADHSAARIFSPSRSYIQLELVLGTLACGQTQEIRIHFLLNEDALKDAKDLTFYYLIKARGSIFNSGSHVLPLEQGKVKGVVSFPIRVEPGMAPVAKLIVYTILPNEELIADVQKFDIEKCFANTVNLSFPSAQSLPASDTHLTVKATPLSLCALTAVDQSVLLLKPEAKLSPQSIYNLLPQKAEQGAYLGPLPYKGGENCIKAEDITHNGIVYTPKQDLNDNDAYSVFQSIGLKIFTNTRVHKPRYCPMYQAYPPLPYVGEPQALAMSAIPGAGYRSSNIRTSSMMMMGASEVAQEVEVRETVRKYFPETWIWDMVPLDLSGDGELPVKVPDTITEWKASAFCLSGTTGLGLSSTISHKVFQPFFLELTLPYSVVRGEAFILKATVLNYMPHCIRIHVSLEMSPDFLAVPVGSHEDSHCICGNERKTVSWAVTPKSLGEVNFTATAEALQSPELCGNKVAEVPALVQKDTVVKPVIVEPEGIEKEQTYNTLLCPQDAELQENWTLDLPANVVEGSARATQSVLGDILGSAMQNLQNLLQMPYGCGEQNMVLFVPNIYVLEYLNETQQLTEAIKSKAISYLISGYQRQLNYQHSDGSYSTFGDRGMRHSQGNTWLTAFVLKAFAQAQSYIYIEKTHITNAFNWLSMKQRENGCFQQSGSLLNNAMKGGVDDEVTLSAYITIALLEMPLPVTHSVVRNALFCLETAWASISNSQESHVYTKALLAYAFALAGNRAKRSEVLESLNKDAVNEEESVHWQRPKNVEENVREMRSFSYKPRAPSAEVEMTAYVLLAYLTSASSRPTRDLSSSDLTTASKIVKWISKQQNSHGGFSSTQDTVVALQALSKYGAATFTKSNKEVSVTIESSGTVSGTLHVNNGNRLLLQEVRLADLPGNYITKVSGSGCVYLQTSLKYNILPEAEGEAPFTLKVNTLPLNFDKAEHHRKFQIHINVSYIGERPNSNMVIVDVKMVSGFIPVKPSVKKLQDQSNIQRTEVNTNHVLIYIEKLTNQTMGFSFAVEQDIPVKNLKPAPVKVYDYYETDEFAIEEYSAPFSSDSEQGNA

SEQ ID NO: 2756 - protein, 109 aa, Rattus norvegicus
VLVLEEAKKKSEKTTKDYPKSWLIKSLFKTFHVVILKSFILKLIHDLLVFLNPQLLKLLIGFVKSSNSYVWFGYICAILMFAVTLIQSFCLQSYFQHCFVLGMCVRTTV

SEQ ID NO: 2757 - protein, 85 aa, Rattus norvegicus
LDIKPGQLVAVVGTVGSGKSSLVSAMLGEMENVHGHITIQGSTAYVPQQSWIQNGTIKDNILFGSEYNEKKYQQVLKACALLPDL

SEQ ID NO: 2758 - protein, 285 aa, Rattus norvegicus
MDSNRTVVHVLSRTLYHMLLWTAVLNLVAESHAGLPKAVVKLEPPWIQVLKEDTVTLMCEGTHNTKNCSTQWFHNGSSIWHQAQANYTFKATVNDSGEYRCRMEETGISEPIHLGVISDWLLLQTSQLVFEEGETITLRCHSWKNKQLTKVLLFQNGKPVRYYHQSSNFSIPKANHSHSGNYYCKAYLGRTMHVSKPVTITVQEPKSSSSLPVLTIVAAVAGIAVAAIVIILVSLVYLKKKQVPDTPSGLEEAEKNEVENTITYSLLKHPEAPDEESDHDYQNHI

SEQ ID NO: 2759 - protein, 729 aa, Rattus norvegicus
MNPFQKNESKETLFSPVSTEEMLPRPPSPPKKSPPKIFGSSYPVSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLAINAGSLISTFITPMLRGDVKCFGQDCYALAFGVPGLLMVLALVVFAMGSKMYRKPPPEGNIVAQVIKCIWFALCNRFRNRSGDLPKRQHWLDWAAEKYPKHLIADVKALTRVLFLYIPLPMFWALLDQQGSRWTLQANKMNGDLGFFVLQPDQMQVLNPFLVLIFIPLFDLVIYRLISKCRINFSSLRKMAVGMILACLAFAVAALVETKINGMIHPQPASQEIFLQVLNLADGDVKVTVLGSRNNSLLVESVSSFQNTTHYSKLHLEAKSQDLHFHLKYNSLSVHNDHSVEEKNCYQLLIHQDGESISSMLVKDTGIKPANGMAAIRFINTLHKDLNISLDTDAPLSVGKDYGVSAYRTVLRGKYPAVHCETEDKVFSLDLGQLDFGTTYLFVITNITSQGLQAWKAEDIPVNKLSIAWQLPQYVLVTAAEVMFSVTGLEFSYSQAPSSMKSVLQAAWLLTVAVGNIIVLVVAQFSGLAQWAEFVLFSCLLLVVCLIFSVMAYYYVPLKSEDTREATDKQIPAVQGNMINLETKNTRL

SEQ ID NO: 2760 - protein, 130 aa, Rattus norvegicus
TDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGK

SEQ ID NO: 2761 - protein, 130 aa, Rattus norvegicus; identical to SEQ ID NO: 2760

SEQ ID NO: 2762 - protein, 61 aa, Rattus norvegicus
IVHDGGMLMLLPFLLRHHKVWRKCKMRIFTVAQMDDNSIQMKKDLTTFLYHLRITAEVEVV

SEQ ID NO: 2763 - protein, 69 aa, Rattus norvegicus
LLPFLLRHHKVWRKCKMRIFTVAQMDDNSIQMKKDLTTFLYHLRITAEVEVVEMHESDISAYTYEKTLV

SEQ ID NO: 2764 - protein, 159 aa, Rattus norvegicus; identical to SEQ ID NO: 2726

SEQ ID NO: 2765 - protein, 66 aa, Rattus norvegicus; identical to SEQ ID NO: 2727

SEQ ID NO: 2766 - protein, 263 aa, Xenopus laevis
MNISRVLFAVVLVLTVSTYECRPRGRILGGQDSKEKTWPFMASIQKNEVHQCGGVLISDKWVLSAAHCATDSNNSSLHVMLGAISLTKPEQYKIVLKVEREIPHPLYNSTKKHHDLLLLELSEKVTLSEAVKPLPFETENIDIPDGKRCLVAGWGQMKSTGKKPDTLQELWIPVISRDVCNRRNYYDNEITPNMICAIEAKKDSCEGDSGGPLVCDGIAVAIVQGGYRRCGLSKKPGIYTLIAPYKSWIMETMYNATLLPSPL

SEQ ID NO: 2767 - protein, 209 aa, Xenopus laevis
MSLLLQHQFKPLPADKQIDTCSFLDSVSHLPAFFDCLGSAIFSPIKADITGNITKIRSVYESNPTKFKTLQMILEGEKELHGPQWPKVGATLALMWLKRGLKFIQVMLQSIADGERDDQNPNLIKVNITKAYEIALQKYHGWLVQKLFQTALFAAPYKDVFLKALSKGQTVKEEECIEKIRQFLVNYTTTIEAIYIMYNKMNAELDYKA

SEQ ID NO: 2768 - protein, 406 aa, Meriones unguiculatus
MTSSISWGLLLLAGLCCLVPSFLAEDAEKTDSSHQDHIMASNLADFAFGLYRVLSHQSNTTNIFLSPLSIATALAMLSLGSKDDTKAQLLQGLHFNLTETSEADIHKGFQHLLKTLNRPDNELQLTTGSSLFVNNSLNLVEKFLEEVKNHYHSEAFFVNFADSEEAKKTINSFVEKATHGKIVDLVKDLEIDTVLALVNYIFFRGKWEKPFDPELTEEADFHVDKSTTVKVPMMNRMGMFDVHYCDTLSSWVLLMDYLGNATAIFILPDEGKMQHLEQTLTKEHIYKFLQNRHTRSANVHLPKLSISGTYNLKKVLSPLGITQVFSNGADLSGITTDVPLKLSKAVHKAVLTLDERGTEAAGTTVLEAVPMSIPPDVCFKNPFVVIICDKHTQSPLFVGKVVNPTQ

SEQ ID NO: 2769 - protein, 562 aa, Mus musculus
MCLSALILVSLAAFTAGAGHPSSPPMVDTVQGKVLGKYISLEGFTQPVAVFLGVPFAKPPLGSLRFAPPQPAEPWSSVKNATSYPPMCFQDPVTGQIVNDLLTNRKEKIPLQFSEDCLYLNIYTPADLTKSDRLPVMVWIHGGGLVLGGASTYDGLVLSTHENVVVVVIQYRLGIWGFFSTGDEHSRGNWGHLDQVAALHWVQDNIAKFGGDPGSVTIFGESAGGESVSVLVLSPLAKNLFQRAISESGVALTAGLVKKNTRPLAEKIAVISGCKNTTSAAMVHCLRQKTEEELLGTTLKLNLFKLDLHGDSRQSHPFVPTVLDGVLLPKMPEEILAEKNFNTVPYIVGINKQEFGWILPTMMNYPPSDVKLDQMTAMSLLKKSSFLLNLPEDAIAVAIEKYLRDKDYTGRNKDQLLELIGDVVFGVPSVIVSRGHRDAGAPTYMYEFQYSPSFSSEMKPDTVVGDHGDEIYSVFGAPILRGGTSEEEINLSKMMMKFWANFARNGNPNGQGLPHWPEYDQKEGYLQIGATTQQAQKLKEKEVAFWTELLAKKQLPTEHTEL

SEQ ID NO: 2770 - protein, 1218 aa, Mus musculus
MSKLKVVGEKSLTNSSRVVGLLAQLEKINTDSTESDTARYVTSKILHLAQSQEKTRREMTTKGSTGMEVLLSTLENTKDLQTVLNILSILIELVSSGGGRRASFLVAKGGSQILLQLLMNASKDSPPHEEVMVQTHSILAKIGPKDKKFGVKARVNGALTVTLNLVKQHFQNYRLVLPCLQLLRVYSTNSVNSVSLGKNGVVELMFKIIGPFSKKNSGLMKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPIIPVTGPVAQLYSLPPEVDDVVDESDDNDDIDLEVENELENEDDLDQSFKNDDIETDINKLRPQQVPGRTIEELKMYEHLFPELVDDFQDYELISKEPKPFVFEGKARGPIVVPTAGEEVPGNSGSVKKGVVMKERASPKGEEAKEDPKGHDRTLPQQLGGQSRVAPSAHSFNNDLVKALDRITLQNVPSQVASGLNAGMRKDFGLPLTVLSCTKACPHVAKCGSTLFEGRTVHLGKLCCTGVETEDDEDTESHSSTEQAPSVEASDGPTLHDPDLYIEIVKNTKSVPEYSEVAYPDYFGHIPPPFKEPILERPYGVQRTKIAQDIERLIHQNDIIDRVVYDLDNPTYTTPEEGDTLKFNSKFESGNLRKVIQIRKSEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNICPLVTITAMPESNYYEHICQFRTRPYIFLSARVHPGETNASWVMKGTLEYLMSNSPTAQSLRESYIFKIVPMLNPDGVINGNHRCSLSGEDLNRQWQSPNPELHPTIYHAKGLLQYLAAVKRLPLVYCDYHGHSRKKNVFMYGCSIKETVWHTHDNSASCDIVEDMGYRTLPKILSHIAPAFCMSSCSFVVEKSKESTARVVVWREIGVQRSYTMESTLCGCDQGRYKGLQIGTRELEEMGAKFCVGLLRLKRLTSSLEYNLPSNLLDFENDLIESSCKVTSPTTYVLDEDEPRFLEEVDYSAESNDELDVELAENTGDYEPSAQEEALSDSEVSRTHLI

SEQ ID NO: 2771 - protein, 1174 aa, Mus musculus
MSKLKVVGEKSLTNSSRVVGLLAQLEKINTDSTESDTARYVTSKILHLAQSQEKTRREMTTKGSTGMEVLLSTLENTKDLQTVLNILSILIELVSSGGGRRASFLVAKGGSQILLQLLMNASKDSPPHEEVMVQTHSILAKIGPKDKKFGVKARVNGALTVTLNLVKQHFQNYRLVLPCLQLLRVYSTNSVNSVSLGKNGVVELMFKIIGPFSKKNSGLMKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPIIPVTGPVAQLYSLPPEVDDVVDESDDNDDIDLEVENELENEDDLDQSFKNDDIETDINKLRPQQVPGRTIEELKMYEHLFPELVDDFQDYELISKEPKPFVFEGKARGPIVVPTAGEEVPGNSGSVKKGVVMKERASPKGEEAKEDPKGHDRTLPQQLGGQSRVAPSAHSFNNDLVKALDRITLQNVPSQVASGLNAGMRKDFGLPLTVLSCTKACPHVAKCGSTLFEGRTVHLGKLCCTGVETEDDEDTESHSSTEQAPSVEASDGPTLHDPDLYIEIVKNTKSVPEYSEVAYPDYFGHIPPPFKEPILERPYGVQRTKIAQDIERLIHQNDIIDRVVYDLDNPTYTTPEEGDTLKFNSKFESGNLRKVIQIRKSEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNICPLVTITAMPESNYYEHICQFRTRPYIFLSARVHPGETNASWVMKGTLEYLMSNSPTAQSLRESYIFKIVPMLNPDGVINGNHRCSLSGEDLNRQWQSPNPELHPTIYHAKGLLQYLAAVKRLPLVYCDYHGHSRKKNVFMYGCSIKETVWHTHDNSASCDIVEDMGYRTLPKILSHIAPAFCMSSCSFVVEKSKESTARVVVWREIGVQRSYTMESTLCGCDQGRYKGLQIGTRELEEMGAKFCVGLLRLKRLTSSLEYNLPSNLLDFENDLIESSCKVTRTRGSSELQLFPAVL

SEQ ID NO: 2772 - protein, 349 aa, Rattus norvegicus
MEVQESGSGSAESGTQEPSPVPSKTTGHYELPWVEKYRPVKLNEIVGNEDTVSRLEVFAREGNVPNIIIAGPPGTGKTTSILCLARALLGPALKDAVLELNASNDRGIDVVRNKIKMFAQQKVTLPKGRHKIIILDEADSMTDGAQQALRRTMEIYSKTTRFALACNASDKIIEPIQSRCAVLRYTKLTDAQVLSRLMNVIEKEKVPYTDDGLEAIIFTAQGDMRQALNNLQSTFSGFGYINSENVFKVCDEPHPLLVKEMIQHCVDANIDEAYKILAHLWHLGYSPEDVIGNIFRVCKTFPMAEYLKLEFIKEIGYTHMKVAEGVNSLLQMAGLLARLCQKTMAPVAS

SEQ ID NO: 2773 - protein, 133 aa, Rattus norvegicus
GVGLLLLVALVVVVVIVLWPRSPLVWKGKPTTKHFADIILGRCLIYTQILRPEMRDQDCKKILSTFKRGFISKNPCNITNEDYAPLVKLVTQTIPCNKTLFWSKSKHLAHQYTWIQGKMFTLEDTLLGYIADD

SEQ ID NO: 2774 - protein, 118 aa, Rattus norvegicus
VGLLLLVALVVVVVIVLWPRSPLVWKGKPTTKHFADIILGRCLIYTQILRPEMRDQDCKKILSTFKRGFISKNPCNITNEDYAPLVKLVTQTIPCNKTLFWSKSKHLAHQYTWIQGKM

SEQ ID NO: 2775 - protein, 305 aa, Rattus norvegicus
MEDGELIKYFKSQMKGDPNMASAVAAIQTLLEFLKRDKGETIQGLRAHLTKAIETLCAVDSSVAVSSGGELFLRFISLTSLEYSDYSKCKKIMIERGELFLSRISLSRTKIASLCHAFIKDGARILTHAYSRVVLRVLEEAVAAKKRFSVYITESQPDLSGKKMAKALCHLNVPVTVVLDAAVGYIMEKVDLVIVGAEGVVENGGIINKIGTNQMAVCAKAQNKPFYVVAESFKFVRLFPLNQQDVPDKFKYKADTLKSVQAGQDLKEEHPWVDYTSPSLITLLFTDLGVLTPSAVSDELIKLYL

SEQ ID NO: 2776 - protein, 79 aa, Xenopus laevis
CVKDCYIQNVAISTLLEVINHSQSLSLVLADRMKRSKTPGFGEVFGKLQMVTIPPVSPGVLKLIADKTDFYPRVAHVLW

SEQ ID NO: 2777 - protein, 80 aa, Xenopus laevis
KDCYIQNVAISTLLEVINHSQSLSLVLADRMKRSKTPGFGEVFGKLQMVTIPPVSPGVLKLIADKTDFYPRVAHVLWNQL

SEQ ID NO: 2778 - protein, 68 aa, Rattus norvegicus
SKDQPRVLLPLANVALIDYTLEFLTATGVQETFVFCCWKAAQIKEHLQKSKWCHPTSLNVVRIITSDL

SEQ ID NO: 2779 - protein, 112 aa, Rattus norvegicus
LIDYTLEFLTATGVQETFVFCCWKAAQIKEHLQKSKWCHPTSLNVVRIITSDLYRSLGDVLRDVDAKALVRSDFLLIYGDVVSNINISKALEEHRLRRKLEKNVSVMTMVFK

SEQ ID NO: 2780 - protein, 763 aa, Rattus norvegicus
MVASRAIGSLSRFSAFRILRSRGCICHSFTTSSALLSRTHINYGVKGDVAVIRINSPNSKVNTLNKEVQSEFVEVMNEIWANDQIRSAVLISSKPGCFVAGADINMLASCTTPQEAARISQEGQKMFEKLEKSPKPVVAAISGSCLGGGLELAIACQYRIATKDRKTVLGVPEVLLGILPGAGGTQRLPKMVGVPAAFDMMLTGRNIRADRAKKMGLVDQLVDPLGPGIKSPEERTIEYLEEVAVNFAKGLADRKVSAKQSKGLMEKLTSYAMTIPFVRQQVYKTVEEKVKKQTKGLYPAPLKIIDAVKTGLEQGNDAGYLAESEKFGELALTKESKALMGLYNGQVLCKKNKFGAPQKTVQQLAILGAGLMGAGIAQVSVDKGLKTLLKDTTVTGLGRGQQQVFKGLNDKVKKKALTSFERDSIFSNLIGQLDYKGFEKADMVIEAVFEDLAVKHKVLKEVESVTPEHCIFASNTSALPINQIAAVSQRPEKVIGMHYFSPVDKMQLLEIITTDKTSKDTTASAVAVGLKQGKVIIVVKDGPGFYTTRCLAPMMSEVIRILQEGVDPKKLDALTTGFGFPVGAATLADEVGIDVAQHVAEDLGKAFGERFGGGSVELLKLMVSKGFLGRKSGKGFYIYQSGSKNKNLNSEIDNILVNLRLPAKPEVSSDEDIQYRVITRFVNEAVLCLQEGILATPEEGDIGAVFGLGFPPCLGGPFRFVDLYGAQKVVDRLRKYESAYGTQFTPCQLLRDLANNSSKKFYQ

SEQ ID NO: 2781 - protein, 68 aa, Mus musculus
KALKHKTANMDVLIVLATTIAFAYSLVILLVAMFERAKVNPITFFDTPPMLFVFIALGRWLEHIAKGK

SEQ ID NO: 2782 - protein, 87 aa, Mus musculus
KALKHKTANMDVLIVLATTIAFAYSLVILLVAMFERAKVNPITFFDTPPMLFVFIALGRWLEHIAKGKTSEALAKLISLQATEATIV

SEQ ID NO: 2783 - protein, 183 aa, Rattus norvegicus
QFLGGWYFYVQAYKSLRHKSANMDVLIVLATTIAYAYSLVILVVAIAEKAEKSPVTFFDTPPMLFVFIALGRWLEHVAKSKTSEALAKLMSLQATEATVVTLGEDNLILREEQVPMELVQRGDIIKVVPGGKFPVDGKVLEGNTMADESLITGEAMPVTKKPGSIVIAGSINAHGSVLIKATH

SEQ ID NO: 2784 - protein, 73 aa, Rattus norvegicus
HKSANMDVLIVLATTIAYAYSLVILVVAIAEKAEKSPVTFFDTPPMLFVFIALGRWLEHVAKSKTSEALAKLM

SEQ ID NO: 2785 - protein, 208 aa, Rattus norvegicus
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQLYVNSTLKELRRLFLVQDLVDSLKFAVLMWLLTYVGALFNGLTLLLMAVVSMFTLPVVYVKHQAQVDQYLGLVRTHINTVVAKIQAKIPGAKRHAE

SEQ ID NO: 2786 - protein, 919 aa, Rattus norvegicus
MKVARFQKIPNVENETMIPVLTSKRASELAVSEVAGLLQADLQNGLNKSEVSHRRAFHGWNEFDISEDEPLWKKYISQFKNPLIMLLLASAVISVLMRQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGIVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHILTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYNSKGQTLALTQQQRDLYQQEKAQMGSAGLRVLALASGPDLGQLTLLGLVGIIDPPRTGVKEAVTTLIASGVSIKMITGDSQETAIAIASRLGLYSKTSQSVSGEEVDTMEVQHLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNKMFCYAVLGSIMGQLLVIYFPPLQKVFQTESLSILDLLFLLGLTSSVCIVSEIIKKVERSREKTQKNTTSTPSSFLEV

SEQ ID NO: 2787 - protein, 923 aa, Rattus norvegicus
MKVARFQKIPNVENETMIPVLTSKRASELAVSEVAGLLQADLQNGLNKSEVSHRRAFHGWNEFDISEDEPLWKKYISQFKNPLIMLLLASAVISVLMRQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGIVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHILTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYNSKGQTLALTQQQRDLYQQEKAQMGSAGLRVLALASGPDLGQLTLLGLVGIIDPPRTGVKEAVTTLIASGVSIKMITGDSQETAIAIASRLGLYSKTSQSVSGEEVDTMEVQHLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNKMFCYAVLGSIMGQLLVIYFPPLQKVFQTESLSILDLLFLLGLTSSVCIVSEIIKKVERSREKTQKNTTSTPSSFLEFYPKI

SEQ ID NO: 2788 - protein, 359 aa, Cricetulus griseus
MRSIRKRWTICTISLLLIFYKTKEIARTEEHQETQLIGDGELCLSRSLVNSSDKIIRKAGSTIFQHSVQGWRINSSLVLEIRKNILRFLDAERDVSVVKSSFKPGDVIHYVLDRRRTLNISHDLHSLLPEVSPMKNRRFKTCAVVGNSGILLDSGCGKEIDSHNFVIRCNLAPVVEFAADVGTKSDFITMNPSVVQRAFGGFRNESDRAKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCMKQ

SEQ ID NO: 2789 - protein, 140 aa, Cricetulus griseus
ILLDSGCGKEIDSHNFVIRCNLAPVVEFAADVGTKSDFITMNPSVVQRAFGGFRNESDRAKFVHRLSMLNDSVLWIPAFMVKGGEKHVEWVNALILKNKLKVRTAYPSLRLIHAVRGYWLTNKVPIKRPSTGLLMYTLAT

SEQ ID NO: 2790 - protein, 79 aa, Cricetulus griseus; identical to SEQ ID NO: 1516

SEQ ID NO: 2791 - protein, 359 aa, Mus musculus
MRSIRKRWTICTISLLLIFYKTKEIARTEEHQETQLIGDGELCLSRSLVNSSDKIIRKAGSTIFQHSVQGWKINSSLVLEIRKNILRFLDAERDVSVVKSSFKPGDVIHYVLDRRRTLNISHNLHSLLPEVSPMKNRRFKTCAVVGNSGILLDSGCGKEIDSHNFVIRCNLAPVVEFAADVGTKSDFITMNPSVVQRAFGGFRNESDREKFVHRLSMLNDSVLWIPAFMVKGGEKHVEWVNALILKNKLQVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCMKQ

SEQ ID NO: 2792 - protein, 81 aa, Mus musculus
SMLNDSVLWIPAFMVKGGEKHVEWVNALILKNKLQVRTAYPSLRLIHAVRGYWLTNKVPIKRPSTGLLMYTLATRFCDEIH

SEQ ID NO: 2793 - protein, 67 aa, Mus musculus
MVKGGEKHVEWVNALILKNKLQVRTAYPSLRLIHAVRGYWLTNKVPIKRPSTGLLMYTLATRFCDEI

SEQ ID NO: 2794 - protein, 1010 aa, Mus musculus
MAARVLVIGSGGREHTLAWKLAQSPQVKQVLVAPGNAGTACAGKISNAAVSVNDHSALAQFCKDEKIELVVVGPEAPLAAGIVGDLTSAGVRCFGPTAQAAQLESSKKFAKEFMDRHEIPTAQWRAFTNPEDACSFITSANFPALVVKASGLAAGKGVIVAKSQAEACRAVQEIMQEKSFGAAGETVVVEEFLEGEEVSCLCFTDGKTVAEMPPAQDHKRLLDGDEGPNTGGMGAYCPAPQVSKDLLVKIKNTILQRAVDGMQQEGAPYTGILYAGIMLTKDGPKVLEFNCRFGDPECQVILPLLKSDLYEVMQSTLDGLLSASLPVWLENHSAVTVVMASKGYPGAYTKGVEITGFPEAQALGLQVFHAGTALKDGKVVTSGGRVLTVTAVQENLMSALAEARKGLAALKFEGAIYRKDIGFRAVAFLQRPRGLTYKDSGVDIAAGNMLVKKIQPLAKATSRPGCSVDLGGFAGLFDLKAAGFKDPLLASGTDGVGTKLKIAQLCNKHDSIGQDLVAMCVNDILAQGAEPLFFLDYFSCGKLDLSTTEAVIAGIAAACQQAGCALLGGETAEMPNMYPPGEYDLAGFAVGAMERHQKLPQLERITEGDAVIGVASSGLHSNGFSLVRKIVERSSLQYSSPAPGGCGDQTLGDLLLTPTRIYSHSLLPIIRSGRVKAFAHITGGGLLENIPRVLPQKFGVDLDASTWRVPKVFSWLQQEGELSEEEMARTFNCGIGAALVVSKDQAEQVLHDVRRRQEEAWVIGSVVACPEDSPRVRVKNLIETIQTNGSLVANGFLKSNFPVQQKKARVAVLISGTGSNLQALIDSTRDPKSSSHIVLVISNKAAVAGLDRAERAGIPTRVINHKLYKNRVEFDNAVDHVLEEFSVDIVCLAGFMRILSGPFVRKWDGKMLNIHPSLLPSFKGSNAHEQVLEAGVTITGCTVHFVAEDVDAGQIILQEAVPVRRGDTVATLSERVKVAEHKIFPAALQLVASGAVQLREDGKIHWAKEQ

SEQ ID NO: 2795 - protein, 433 aa, Mus musculus
MAARVLVIGSGGREHTLAWKLAQSPQVKQVLVAPGNAGTACAGKISNAAVSVNDHSALAQFCKDEKIELVVVGPEAPLAAGIVGDLTSAGVRCFGPTAQAAQLESSKKFAKEFMDRHEIPTAQWRAFTNPEDACSFITSANFPALVVKASGLAAGKGVIVAKSQAEACRAVQEIMQEKSFGAAGETVVVEEFLEGEEVSCLCFTDGKTVAEMPPAQDHKRLLDGDEGPNTGGMGAYCPAPQVSKDLLVKIKNTILQRAVDGMQQEGAPYTGILYAGIMLTKDGPKVLEFNCRFGDPECQVILPLLKSDLYEVMQSTLDGLLSASLPVWLENHSAVTVVMASKGYPGAYTKGVEITGFPEAQALGLQVFHAGTALKDGKVVTSGGRVLTVTAVQENLMSALAEARKGLAALKFEGAIYRKDIGFRAVAFLQRPR

SEQ ID NO: 2796 - protein, 738 aa, Oryza sativa
MGTSVQVTPLSGAYGEGPLCYLLAVDGFRFLLDCGWTDLCDPSHLQPLAKVAPTIDAVLLSHADTMHLGALPYAMKHLGLSAPVYATEPVFRLGILTLYDYFISRRQVSDFDLFTLDDIDAAFQNVVRLKYSQNHLLNDKGEGIVIAPHVAGHDLGGTVWKITKDGEDVVYAVDFNHRKERHLNGTALGSFVRPAVLITDAYNALNNHVYKRQQDQDFIDALVKVLTGGGSVLLPIDTAGRVLEILLILEQYWAQRHLIYPIYFLTNVSTSTVDYVKSFLEWMNDSISKSFEHTRDNAFLLKCVTQIINKDELEKLGDAPKVVLASMASLEVGFSHDIFVDMANEAKNLVLFTEKGQFGTLARMLQVDPPPKAVKVTMSKRIPLVGDELKAYEEEQERIKKEEALKASLNKEEEKKASLGSNAKASDPMVIDASTSRKPSNAGSKFGGNVDILIDGFVPPSSSVAPMFPFFENTSEWDDFGEVINPEDYLMKQEEMDNTLMPGAGDGMDSMLDEGSARLLLDSTPSKVISNEMTVQVKCSLAYMDFEGRSDGRSVKSVIAHVAPLKLVLVHGSAEATEHLKMHCSKNSDLHVYAPQIEETIDVTSDLCAYKVQLSEKLMSNVISKKLGEHEIAWVDAEVGKTDDKLTLLPPSSTPAAHKSVLVGDLKLADFKQFLANKGLQVEFAGGALRCGEYITLRKIGDAGQKGSTGSQQIVIEGPLCEDYYKIRELLYSQFYLL

SEQ ID NO: 2797 - protein, 440 aa, Oryza sativa
MGDFNVALVIVAAVVSVLVLLVSVYLLINYQHPDDANQAYFPKLVVVLGITVALLSILMLPADVANRQACRRAIYSGACSLTLPMKTLWLAVYIADAVLVFLVIPFAMFYYEGDQDKSVGKRLTSALLWVAVSAVVCGLILGILYGLVGKVDFTVRHLSSAVETFPNSFTSFSTGQPCISTSPKQEATELGKKARELKKAAEALHQEEKSGKKGRKWRKNVKALGKELVLLEDDMKALEEMYPQGEQAEATWALTVLGYIGKLLFGAVGLIISIAWVAHIVIYLLIDPPLSSFLNEIFVKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYAIFGWRKRKPTGRFQLSN

SEQ ID NO: 2798 - protein, 736 aa, Equus caballus
MSSESKEPHVLSPKDSFEGNDRYSPPSRIHLELEKKSSTDFKQFEASEPCRPYPRIHMEPQEKSNTNFKQFVIKKLQKSCQCSPTKAKNMIFGFLPVLQWLPKYDLKKNILGDVMSGLIVGILLVPQSIAYSLLAGQEPIYGLYTSFFASLIYFLLGTSRHISVGIFGVLCLMIGEVVDRELLKAGYDTVHIAPSLGMVSNGSTSLNQTSDRICDRSCYAIKVGSTVTFLAGIYQVAMGFFQVGFVSVYLSDALLSGFVTGASFTILTSQAKYLLGLSLPRSSGVGSLITTWIHIFRNIHKTNVCDLITSLLCLLVLLPTKELNEHFKSKLKAPIPTELVVVVAATLASHFGKLHEKYNTSIAGHIPTGFMPPKAPDWNLIPSVAVDAIAISIIGFAITVSLSEMFAKKHGYTVKANQEMYAIGFCNIIPSFFHCFTTSAALAKTLVKESTGCQSQLSGVMTALVLLLVLLVIAPLFYSLQKSVLGVITIVNLRGALRKFRDLPKMWRVSRMDTVIWFVTMLSSALISTELGLLIGVCFSMFCVILRTQKPKVSLLGLVEETEIFESMSAYKNLQARPGIKIFRFVAPLYYINKECFKSALYKKTLNPVLVKAAQKKAAKRKIKKQPVTLSGIQNEISVQLSHDPLELRTIVIDCSAIQFLDTAGIHTLKEVRRDYEAIGIQVLLAQCNPSVRDSLARGEYCKDEEENLLFYSVYEAMAFAEESQNQKGICIPNGL

SEQ ID NO: 2799 - protein, 199 aa, Equus caballus
LVLLPTKELNEHFKSKLKAPIPTELVVVVAATLASHFGKLHEKYNTSIAGHIPTGFMPPKAPDWNLIPSVAVDAIAISIIGFAITVSLSEMFAKKHGYTVKANQEMYAIGFCNIIPSFFHCFTTSAALAKTLVKESTGCQSQLSGVMTALVLLLVLLVIAPLFYSLQKSVLGVITIVNLRGALRKFRDLPKMWRVSRMD

SEQ ID NO: 2800 - protein, 180 aa, Equus caballus
KSKLKAPIPTELVVVVAATLASHFGKLHEKYNTSIAGHIPTGFMPPKAPDWNLIPSVAVDAIAISIIGFAITVSLSEMFAKKHGYTVKANQEMYAIGFCNIIPSFFHCFTTSAALAKTLVKESTGCQSQLSGVMTALVLLLVLLVIAPLFYSLQKSVLGVITIVNLRGALRKFRDLPKMW

SEQ ID NO: 2801 - protein, 119 aa, Rattus norvegicus
AMMWDYTIPILEIKLKILPVLGVVGGLIFSCSNYFHVILHGGVGKNGSTIAGTSVLSPGLHIGLIIILAIMIYKKSATNVFEKHPCLYTLMFGCVFAKVAQKLVIAHMTKSELYLQDTV

SEQ ID NO: 2802 - protein, 107 aa, Rattus norvegicus
WDYTIPILEIKLKILPVLGVVGGLIFSCSNYFHVILHGGVGKNGSTIAGTSVLSPGLHIGLIIILAIMIYKKSATNVFEKHPCLYTLMFGCVFAKVAQKLVIAHMTK

SEQ ID NO: 2803 - protein, 953 aa, Danio rerio
MTAAENVCYTLINVTNDSEPPSEVSLKTDLEKGEIKAKTEALKKVIIMILNGEKLPGLLMTIIRFVLPLQDHTIKKLLLVFWEIVPKTTPDGKLLQEMILVCDAYRKDLQHPNEFIRGSTLRFLCKLKESELLEPLMPAIRACLEHRHSYVRRNAVLAIYTIYRNFEHLIPDAPELIHDFLVNEKDASCKRNAFMMLIHADQDRALDYLSTCIDQVHTFGDILQLVIVELIYKVCHANPSERARFIRCIYNLLQSSSPAVKYEAAGTLVTLSSAPTAIKAAAQCYIDLIIKESDNNVKLIVLDRLIELKEHPTHERVLQDLVMDILRVLTTPDLEVRKKTLQLALDLVSSRNVEELVIVLKKEVIKTNNVTEHEDTDKYRQLLVRTLHSCSVRFPDMAANVIPVLMEFLSDTNEAAAADVLEFVREAIQRFDNLRPLIIEKMLEVFHAIKTVKIYRGALWILGEYCSTKEDIQSVMTEVRRSLGEIPIVENELKKEAGEVKPEEEVTAAPAPKLVTEMGTYVTQSALSTSRPSKKEEDRPPLRGFLMDGDFYVAASLATTLTKVALRYVALAEDKRRQNSFVAEAMLIMATVLHLGKSSLPKKPITDDDVDRISLCLKVLSECSPLMNDIFNKECRRSLSHMLAVRLEEEKLSQKKESEKRNVTVQADDPISFMQLTAKNEMASKEDQFQLSLLAAMGNTQRKEATDPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPASCTDAEFRQMWAEFEWENKVTVNTNITDLNDYLLHILKSTNMKCLTPEKALSGICGFMAANLYARSIFGEDALANVSIEKPIHLGVDAPVNGHIRIRAKSQGMALSLGDKINLSQKRTAS

SEQ ID NO: 2804 - protein, 35 aa, Danio rerio
LVFWEIVPKTTPDGKLLQEMILVCDAYRKDLQHPN

SEQ ID NO: 2805 - protein, 32 aa, Danio rerio
VFWEIVPKTTPDGKLLQEMILVCDAYRKDLQH

SEQ ID NO: 2806 - protein, 417 aa, Xenopus tropicalis
MLPNTGKLAGCTLFITGASRGIGKAIALKAARDGANVVIAAKTAEAHPKLPGTIYTAASEIEAAGGKALPCIVDVRDENQISAAVEKAVDTFGGIDILVNNASAISLTNTLETPMKKVDLMMGINTRGTYLTSKICIPYLKKSKVAHILNLSPPLNLNPIWFKNHCAYTIAKYGMSMCALGMSEEYKGEIAVNALWPKTAIHTAAMDMLGGSGVDKQCRTPDIMADAAYAILSKPKDFTGNFVIDEELLKHEGIKDLDVYAVSPGHPLLPDFFLDESPEALASAMEEHGATAAFKAGKAQAKSQDSSPLQETFKAIESLVNEEAVKTTQGIYQFVLSGEESGNWFLDLKNGKGGVGSGEPSTKADVVMSMDSGDFIKMFTGKMKPTMAFMSGKLKIKGDMGLALKLEKILGQMNAKL

SEQ ID NO: 2807 - protein, 210 aa, Thalictrum flavum
MMKMEVVFVFLMLLGTINCQKLILTGRPFLHHQGIINQVSTVTKVIHHELEVAASADDIWTVYSWPGLAKHLPDLLPGAFEKLEIIGDGGVGTILDMTFVPGEFPHEYKEKFILVDNEHRLKKVQMIEGGYLDLGVTYYMDTIHVVPTGKDSCVIKSSTEYHVKPEFVKIVEPLITTGPLAAMADAISKLVLEHKSKSNSDEIEAAIITV

SEQ ID NO: 2808 - protein, 572 aa, Mus musculus
MDSAKTCVTKFKSFAILLFTPILMLPLVILIPDKFARCAYVIVIMAVYWCTDVIPVAVTSLLPVLLFPLLKVLDSKQVCIQYMKDTNMLFLGSLIVAVAVERWKLHKRVALRMLLFVGTKPSRLMLGFMFVTAFLSMWISNTAATAMMIPIVEAMLQQMIAANTAVEASLGTLELLDKNKTSELPGSQVVFEDPNVQEQEDEETKNMYKAMHLCVCYSASIGGTATLTGTGPNVVLLGQMQELFPDSKDVLNYASWFGFAFPNMVMMLVLAWLWLQCLYMRHNLKKTCICCGEKKRDTEKIAYKVLNEEYQKLGSLSYPECNVLFCFTLLVILWFSRDPGFMPGWLSFAWVEGNTVHITDATVAIFVAILLFIIPSQKPKFNFSSQTEEERKTPFYPPALLDWKVAQEKVPWDIVLLLGGGFAMAKGCETSGLSKWMAAQMEPLRLVKPAVITLILSCLVAMTTECTSNVATTTLFLPIFASMARSIGIHPLYVMIPCTMSASLAFMLPVATPPNAIVFAYGHLRVVDMMKTGLIMNFVGILSVFLSVNTWGRAMFNLDNFPDWANSTSVNT

SEQ ID NO: 2809 - protein, 483 aa, Mus musculus
MTWAPDNVRKWSALLLLAIIGTALTAATDPGFVAMISQKGLDFACQQGVVELQKELQAISVPDFSGVFKIKHLGKGSYEFYSMAVDGFHIPNPKIEMLPSDGLRVFIKDASIKINGKWMSRKNFLKAGGNFELSIQGVSISTDLILGSDSSGHITTICSNCDSHIDSVHIKISGSMLGWLIRLFHRKIETSLKNIIYKKICKIVRDSVSSKLQPYLKTLSVITRVDDVTSVDYSLLAPLTTTNQFLEGQLKGEFFWRGHRDPLPIHPPVMRFVPNGAYMVCMGISDYFFNTEVLAYQQSGTLKMTLGGQLLSNNGRFQLNTDFLRTFLPKVAKMFPSMGVQLLISAPVPVHLSIQPSGLSFNPKLETQAFVVLPNASLVPLFVLGMKTNASLEVDAEENRLVGEMKLGSRWLLELKESKFGPFKVEYLEDVINYLVSTLVLPKINERLRRGFPLPLPAGIRFSHFTFYPYQNFLLLEADLHLI

SEQ ID NO: 2810 - protein, 482 aa, Mus musculus
MTWAPDNVRKWSALLLLAIIGTALTAATDPGFVAMISQKGLDFACQQGVVELQKELQAISVPDFSGVFKIKHLGKGSYEFYSMAVDGFHIPNPKIEMLPSDGLRVFIKDASIKINGKWMSRKNFLKAGGNFELSIQGVSISTDLILGSDSSGHITTICSNCDSHIDSVHIKISGSMLGWLIRLFHRKIETSLKNIIYKKICKIVRDSVSSKLQPYLKTLSVITRVDDVTSVDYSLLAPLTTTNQFLEGQLKGEFFWRGHRDPLPIHPPVMRFVPNGAYMVCMGISDYFFNTEVLAYQQSGTLKMTLGGQLLSNNGRFQLNTDFLRTFLPKVAKMFPSMGVQLLISAPVPVHLSIQPSGLSFNPKLETQAFVVLPNASLVPLFVLGMKTNASLEVDAEENRLVGEMKLGRWLLELKESKFGPFKVEYLEDVINYLVSTLVLPKINERLRRGFPLPLPAGIRFSHFTFYPYQNFLLLEADLHLI

SEQ ID NO: 2811 - protein, 486 aa, Mus musculus
MTWAPDNVRKWSALLLLAIIGTALTAATDPGFVAMISQKGLDFACQQGVVELQKELQAISVPDFSGVFKIKHLGKGSYEFYSMAVDGFHIPNPKIEMLPSDGLRVFIKDASIKINGKWMSRKNFLKAGGNFELSIQGVSISTDLILGSDSSGHITTICSNCDSHIDSVHIKISGSMLGWLIRLFHRKIETSLKNIIYKKICKIVRDSVSSKLQPYLKTLSVITRVDDVTSVDYSLLAPLTTTNQFLEGQLKGEFFWRGHRDPLPIHPPVMRFVPNGAYMVCMGISDYFFNTEVLAYQQSGTLKMTLGGQLLSNNGRFQLNTDFLRTFLPKVAKMFPSMGVQLLISAPVPVHLSIQPSGLSFNPKLETQAFVVLPNASLVPLFVLGMVRRKTNASLEVDAEENRLVGEMKLGSRWLLELKESKFGPFKVEYLEDVINYLVSTLVLPKINERLRRGFPLPLPAGIRFSHFTFYPYQNFLLLEADLHLI

SEQ ID NO: 2812 - protein, 328 aa, Oryza sativa
MGTVTTADPHASFLADKGGKVFVAGHRGLVGSAILRHLVSLGFTNVVVRTHAELDLTRQSDVEAFFAAELPRYVVLAAAKVGGIHANSTFPADFIAANLQIQTNVVDAALKCGSVRKLLFLGSSCIYPKFAPQPIPENSLLSGPLEPTNEWYAVAKIAGIKMCQAYRIQHGFDAISAMPTNLYGPQDNFHPENSHVLPALIRRFHEAKASNAAEVVVWGTGSPLREFLHVDDLADAVIFLMDHYSGLEHVNVGSGSEVTIKELAELVKEVVGFQGKLVWDSSKPDGTPRKLMDSSKIQEMGWKPKVPLKEGLVETYKWYVENVISAKK

SEQ ID NO: 2813 - protein, 365 aa, Camellia sinensis
MKEVKEALFMNKGEGESSYAQNSSFTQTVTSMTMPVLENAVETLFSKDFHLLQALNAVDLGCAAGPTTFTVISTIKRMMEKKCRELNCQTLELQVYLNDLPGNDFNTLFKGLPSKVVGNKCEEVSCYVVGVPGSFHGRLFPRNSLHLVHSCYSVHWLTQAPKGLTSKEGLALNKGKIYISKTSPPVVREAYLSQFHEDFTMFLNSRSQEVVPNGCMVLILRGRLSSDPSDMGSCFTWELLAVAIAELVSQGLIDEDKLDTFNVPSYFPSLEEVKDIVERNGSFTIDHMEGFELDSPEMQENDKWVRGEKFATVARAFTEPIISNQFGHEIMDKLYEKFTHIVVSDFEAKIPKITSIILVLSKIVG

SEQ ID NO: 2814 - protein, 520 aa, Rattus norvegicus
MLNVPSQAFPAPGSQQRVASQGRSKVPLKQGRSLMDWFRLTKSGKDFTGLKGGLIEVTEEELKKHNKKDDCWICIRGFVYNVSPYMEYHPGGEDELMRAAGADGTDLFNEVHRWVNYESMLKECLVGRMAVKPAVPKDCHEGKRVLNGMLPKSQVTDTLPREGPSSPSYDWFQTESSVTIVIYTKQKNINLDSVIVDLQDDSLRAEAVIKDHSYLIHIGLSHEVQENFSVRVIENVGKIEIVLQKKETVSWKCLGDPLEKHDSFIPKKDTGLYYRQCQLISKEDVTHDTRLFCLMLPPSTHLQVPVGQHVYLKLSVTGAEIVKPYTPVSESLLSDFKEPVLSPNKYIYFLIKIYPAGLFTPELDRLQIGDFVSVSGPEGNFKVSKLQEVEDLFLLAAGTGFTPMVTVLNHALTHMSSLRKVKLMFFNKTEDDIIWRCQLEKLALKDKRFHVEYVLSAPSPEWNGKQGHVSRALLSEFLQRSLENSKVFLCICGPTPFTDEGIRLLHDLNFSDDEIHGFTA

SEQ ID NO: 2815 - protein, 200 aa, Rattus norvegicus
IEIVLQKKETVSWKCLGDPLEKHDSFIPKKDTGLYYRQCQLISKEDVTHDTRLFCLMLPPSTHLQVPVGQHVYLKLSVTGAEIVKPYTPVSESLLSDFKEPVLSPNKYIYFLIKIYPAGLFTPELDRLQIGDFVSVSGPEGNFKVSKLQEVEDLFLLAAGTGFTPMVTVLNHALTHMSSLRKVKLMFFNKTEDDIIWRCQ

SEQ ID NO: 2816 - protein, 31 aa, Rattus norvegicus
VTVLNHALTHMSSLRKVKLMFFNKTEDDIIW

SEQ ID NO: 2817 - protein, 200 aa, Rattus norvegicus
IVDLQDDSLRAEAVIKDHSYLIHIGLSHEVQENFSVRVIENVGKIEIVLQKKETVSWKCLGDPLEKHDSFIPKKDTGLYYRQCQLISKEDVTHDTRLFCLMLPPSTHLQVPVGQHVYLKLSVTGDFVSVSGPEGNFKVSKLQEVEDLFLLAAGTGFTPMVTVLNHALTHMSSLRKVKLMFFNKTEDDIIWRCQLEKLALK

SEQ ID NO: 2818 - protein, 31 aa, Rattus norvegicus; identical to SEQ ID NO: 2816

SEQ ID NO: 2819 - protein, 432 aa, Xenopus tropicalis
MACKFRLLLENAEQIVVVCSKEEEYLLEDGMQHLAILEKASLVIGNDGFIKDVGPAETIRNQFSNASFENIIDCSGKCVLPGFVDAHTHPVWAGDRVHEFAMKLAGATYMDIHKAGGGINYTVEHTTTASEEELFCSFKHRLERMLRAGTTLVECKSGYGLKLETELKMLRVIERAHQELDIAVSSTYCGAHSVPKGKSAQEATDDIIANHLPALKQMALNGEIHVDNIDVFCEKGVFDLDSTRKILQAGKAIGLNLNFHGDELNPMNSAELGAELGAHAVSHLEEVSDKGIAALAKAKCSAVLLPTTAYILRLKQPRARDMLKAGVIVSLGSDFNPNAYCFSMPMVMHLACVNMKMSLKEALAAATINAAYALGRAHTHGSLEVGKQGDVVVINASRWEHVIYQFGGHQELIEYVVIKGKIVYKNENVLCL

SEQ ID NO: 2820 - protein, 214 aa, Xenopus laevis
MAETSGPQSSHISSSSAGDKGSGCAVRDLLYWRDVKQSGMVFGGTMVLLLSLAAFSIISVISYLVLSLLSVTISFRVYKSVLQAVQKTEEGHPFKPLLEKDIALSSDSFQKGLSSSLAHVNHALKSIVRLFLVEDLVDSLKLALLMWLMTYIGAVFNGITLLILGVLLAFTTPLVYEKYKVQIDHYVSLVHSQVKSITEKIQAKLPGALKKKSE

SEQ ID NO: 2821 - protein, 927 aa, Xenopus laevis
MEDPVQLKEEGNKYFQSNDYGNAIECYSKALKLITDKKMKAVLYRNRSACYLKQENYIQAAADASKAIDVDASDIKALFRRCQALEKLGKLDQAYKDVQRCATLEPKNRTFLEMLHRLGSNIQEKLHVQFSTDSRVQKMFEILLDENSDKEKREKAANNLIVLGREDAGAERIFQNNGVNLLMQLIETKDPELILSAVRTLSGMCTGHRARATAIVHLVGINKICSIMAVDHEEIALAACNLLQNIVDSLTGEDKKVHGKEEALVLDTKKDLKVITTHLLDMLVSKKVSGHGRDQALNLLNKNIPRYDLKNKDNSKTLFVVDVGLKKILKVLGQVPELPNCLPLTPNTRLNASVLINKLYDDLRCDPERDDFRKICEEYITGSFDPKDMEKNLHAIQTVSGILQGPFDLGNILLGMQGVMEMMVALTGSEKEVDQLVAVEALIHASTKLSRASFIITNGVSLLKDIYKKTKNEKIKIRALVGLCKLGSAGGTDYALRQFAEGSTDKLAKQCRKWLCNTSLDIQTRKWAVEGLAYLTLDADVKDEFVEDEQSLKAMFELCKTSDKTILYSVATTLVNCTNSYDVKEVIPEMVQLAKFSKQHVPEQHPKDKKDFVLKRVKKLLQADVISALSCMVKADNSILTDQTKEQIARVFLALCDEPKDRGIIVAQGGGKAMIPLALEGTDVGKTKASHGLAKIAAVSNPDIAFPGERVYEVVRPLVSLLNTERDGVQNFEALLALTNLSGKSDKLRQKIVKEKALPEIENYMFENHEQIRQAATECMCNLAVNKEVKERFTAEGNDRLKLIVLLCGEDEEVKLQRAAAGTLAILTAAEKKLCHKMTEVTSQWLEILQRLCLNEDLQVQHRGVVITYNLISAEKELAKKLVESEMLEILTVIGKQADVPNKQHIINVAREALVKCLDYGFIKTVS

SEQ ID NO: 2822 - protein, 196 aa, Xenopus laevis
AVCIGVSFLVFLCGKTVFVTKPADGSAFTDMVKILAYFCCSRKHTRENTRNIQNNQHRHKQSRLDMAKASHGGPFREDKVEDVKALVKIIPVFLALIPYWTVYFQMQTTYVLQSLHLRIPQIFNNNHTLPAAWLTMFDAVLILILIPLKDKLVDPFLKKRGLLPSPLKRIAVGMFFVMCSVLAAGILESERLEIVK

SEQ ID NO: 2823 - protein, 176 aa, Xenopus laevis
VCIGVSFLVFLCGKTVFVTKPADGSAFTDMVKILAYFCCSRKHTRENTRNIQNNQHRHKQSRLDMAKASHGGPFREDKVEDVKALVKIIPVFLALIPYWTVYFQMQTTYVLQSLHLRIPQIFNNNHTLPAAWLTMFDAVLILILIPLKDKLVDPFLKKRGLLPSPLKRIAVGMFFV

SEQ ID NO: 2824 - protein, 112 aa, Rattus norvegicus
EDGQVPHSLEALYQSAGCSTVSDALIVLVHLLMLESGYIPQGTEAKAASMPEKWKSSGVYKLQYTHPLCEGGSAVLTCVPLGKLIMINATIKVNGGIKNVKSVQLKPGAYVR

SEQ ID NO: 2825 - protein, 34 aa, Rattus norvegicus
WKSSGVYKLQYTHPLCEGGSAVLTCVPLGKLIMI

SEQ ID NO: 2826 - protein, 423 aa, Rattus norvegicus
MANPRVFPLSCVVQQYAWGKVGSKSEVACLLACSDPLTQISEDKPYAELWMGAHPRGDAKILDNRISQKTLGQWIAENQNSLGQKVKDTFNGKLPFLFKVLSVETALSIQAHPNKELAEKLHLQAPEHYPDANHKPEMAIALTPFQGLCGFRPVEEIVTFLKKVPEFQSLIGEDATAQLKKSMNEGSGAMASALKNCFSHLMKSEKKVVVEQLNLLVKRISQQISNGNSMDDICGELLLQLHQQYPGDIGCFAIYLLNLITLKPGEAMFLEANVPHAYLKGDCVECMACSDNTVRAGLTPKFIDVSTLCEMLDYTPSPSKDRLFAPTLSQDDPYLSIYDPPVPDFTVMKIEVPGSVTEYKVLTLDSASILLLVQGTVTAIIPSVQGEIPLSRGGVLFIGANETVLLKLTVPKNLLIFRACCLL

SEQ ID NO: 2827 - protein, 111 aa, Equus caballus
LSHEALKQICLSGLHSWKKKFIRFKNGVITGVYPASPSSWLIVVVGVMSTMYAKIDPSLGIIAKINRTLDTTGYMSSQTKNIVSGVLFGTGLWVALIITMRYSLKVLLSYH

SEQ ID NO: 2828 - protein, 129 aa, Equus caballus
AEAHQAVAFQFTVTPDGIDLRLSHEALKQICLSGLHSWKKKFIRFKNGVITGVYPASPSSWLIVVVGVMSTMYAKIDPSLGIIAKINRTLDTTGYMSSQTKNIVSGVLFGTGLWVALIITMRYSLKVLL

SEQ ID NO: 2829 - protein, 503 aa, Lagenorhynchus acutus
MVLEVLNPRHYNITSMVTEVAPVASIAILLLTGFLLLVWNYEDTSSIPGPGYFLGIGPLISHCRFLWMGIGSTCNYYNKTYGEFVRVWICGEETLIISKSSSMFHIMKHSHYTSRFGSKLGLQCIGMHEKGIIFNNNPALWKAVRPFFTKALSGPGLVRMVTVCADSITKHLDRLEEVRNELGYVDVLTLMRRIMLDTSNKLFLGIPLDERAIVVKIQGYFDAWQALLLKPDIFFKISWLCRKYEKSVKDLKDAMEILIEEKRQRISTAEKLEDCMDFATELIFAEKRGDLTKENVDQCILEMLIAAPDTMSVSVFFMLFLIAKHPQVEEAIMKEIQTVVGERDIRIDDMQKLKVVENFIYESMRYQPVVDLVMRKALEDDVIDGYPVKKGTNIILNIGRMHRLEFFPKPNEFTLENFARNVPYRYFQPFGFGPRACAGKYIAMVMMKVTLVTLLRSFHVQTLQGRCIEKMQKKNDLSLHPDETSDLLGMIFIPRNSDKCLDH

SEQ ID NO: 2830 - protein, 453 aa, Oryza sativa
MGGEEGMAAGRKKRVGRYEVGRTIGQGTFAKVKFAVDADTGAAVAMKVLDKDTILNHRMLHQIKREISIMKIVRHPNIVRLNEVLAGKTKIYIILELITGGELFDKIARQGKLRENEARKYFQQLIDAINYCHSKGVYHRDLKPENLLLDSRGNLKVSDFGLSTLAQKGVGLLHTTCGTPNYVAPEVLSNNGYDGSAADVWSCGVILYVLMAGYLPFEEDDLPTLYDKITAGQFSCPYWFSPGATSLIHRILDPNPKTRITIEQIREDTWFKKTYVAIKRGEDENVDLDDVQAVFDNIEDKYVSEQVTHNDGGPLVMNAFEMITLSQGLDLSALFDRQQEFVKRQTRFVSRKPAKTIVATIEVVAETMGLKVHSQNYKLRLEGVSSNRMSPFAVVLQVFEVAPSLFMVDVRKVAGDTLEYHRFYKNLCNKMESIIWRPIEVSAKSALLRTATC

SEQ ID NO: 2831 - protein, 197 aa, Oryza sativa
HFAATSTFIAREVAKGLMKYQPDVIISVHPLMQHVPLRILRSKGLLDKIPFTTVVTDLSTCHPTWFHKLVTRCYCPSAEVSKRALKAGLQPSQIKVYGLPVRPSFVKPIRPEDELRRELGMDEYLPAVLLMGGGEGMGPIEATARALGDALYDEVLGEPTGQILVICGRNKKLTSRLQSINWKVPVQVKGFVTKMEE

SEQ ID NO: 2832 - protein, 81 aa, Oryza sativa
KYQPDVIISVHPLMQHVPLRILRSKGLLDKIPFTTVVTDLSTCHPTWFHKLVTRCYCPSAEVSKRALKAGLQPSQIKVYGL

SEQ ID NO: 2833 - protein, 101 aa, Mus musculus
LTTLIQQCADSPKPVFVKVINLYHHPGCGGTTLAMHVLWDLKQKFRCAVLKNKATDFVEIGEQVSKLMSYKATSHEDFIPVLLLVDDFEEQENAYILQNAI

SEQ ID NO: 2834 - protein, 110 aa, Mus musculus
LTTLIQQCADSPKPVFVKVINLYHHPGCGGTTLAMHVLWDLKQKFRCAVLKNKATDFVEIGEQVSKLMSYKATSHEDFIPVLLLVDDFEEQENAYILQNAINAFIAEKGL

SEQ ID NO: 2835 - protein, 179 aa, Mus musculus
DIAGFIHKVPGLVTLKKLPCVSFAGVDSLDDVKNHTYNELFVSGGFIVSDESILNLEVVTIESLKIFLTFLEELSTPEGKWQWKIHCKFQKKLKELGRMNTKALSLLTLLNVYQKKHLVEILSYHSCDSQTRNAPEMDCLIRLQAQNIQQRHIVFLTEKNIKMVSSYTDNGIVVATTED

SEQ ID NO: 2836 - protein, 180 aa, Mus musculus
VPGLVTLKKLPCVSFAGVDSLDDVKNHTYNELFVSGGFIVSDESILNLEVVTIESLKIFLTFLEELSTPEGKWQWKIHCKFQKKLKELGRMNTKALSLLTLLNVYQKKHLVEILSYHSCDSQTRNAPEMDCLIRLQAQNIQQRHIVFLTEKNIKMVSSYTDNGIVVATTEDFMQNFTSLV

SEQ ID NO: 2837 - protein, 179 aa, Mus musculus; identical to SEQ ID NO: 2835

SEQ ID NO: 2838 - protein, 180 aa, Mus musculus; identical to SEQ ID NO: 2836

SEQ ID NO: 2839 - protein, 524 aa, Arabidopsis thaliana
MKEIKKTMTKQMTARRDDTPLHTAVREGKTDLLLEMIGEHDGVELKELLAEQNQSGETALYVAAEYGYTDMVKILMKHSDSVLAGTKAKNGFDAFHIAAKNGNLQVLDVLIEANPELSFTFDSSKTTALHTAASQGHGEIVCFLLDKGVDLAAIARSNGKTALHSAARNGHTVIVKKLIEKKAGMVTRVDKKGQTALHMAVKGQNTEIVDVLMEADGSLINSADNKGNTPLHIAVRKNRAEIVQTVLKYCEVSRVAVNKSGETALDIAEKTGLHEIVPLLQKIGMQNARSIKPAEKVEPSGSSRKLKETVSEIGHEVHTQLEQTGRTRREIQGIAKRVNKMHTEGLNNAINSTTLVAILIATVAFAAIFNVPGQYTDDPKDVPPGYSLGEARAAPRPEFLIFVVFDSFALFISLAVVVVQTSVVVIERRAKKQMMAIINKLMWMACIMISVAFVSLSFVVVGEKEKPLAVGVTAIGALIMVSTLGTMCYWVIANRIEGSKSSPASMMSDPELADSKHNRKLYAV

SEQ ID NO: 2840 - protein, 138 aa, Danio rerio
KLPDSLMALNLKLLDLRDNSLTTIKSEHASLLAKKLQTVYMNGNAFNCCHLDWFRTFGENKGIHVADLSEITCLDLNYRRHKVVLTDAVYCGFTNNNKESVVWYILLFVTVSVSIMGISVIYMLTFKPRMLPRVIKKK

SEQ ID NO: 2841 - protein, 127 aa, Danio rerio
KLLDLRDNSLTTIKSEHASLLAKKLQTVYMNGNAFNCCHLDWFRTFGENKGIHVADLSEITCLDLNYRRHKVVLTDAVYCGFTNNNKESVVWYILLFVTVSVSIMGISVIYMLTFKPRMLPRVIKKK

SEQ ID NO: 2842 - protein, 116 aa, Rattus norvegicus
LTLANKIPMPSLFDIRQNIALYGVLRLGSHDIHTMAPLVRSILLVGPSGMGKKMLVQAVCTETGANLFDLSPGNVMGKYPGKNGSQLLMHIVFKVARVFQPSVIWIGNTEKTFYKK

SEQ ID NO: 2843 - protein, 103 aa, Rattus norvegicus
IALYGVLRLGSHDIHTMAPLVRSILLVGPSGMGKKMLVQAVCTETGANLFDLSPGNVMGKYPGKNGSQLLMHIVFKVARVFQPSVIWIGNTEKTFYKKIPKEE

SEQ ID NO: 2844 - protein, 131 aa, Rattus norvegicus
VHSTERMKKRSPVKKIIISLRINDPAVTRVAFALALKNLYMNEVEMTVDNVLGVLASAHILQFNRLFRKCVSTMLNRLTPCTIKNFYLAGCKYKEEQLTNACEKWLAMNLVPLVGTQIHLRHIPEPLLYKV

SEQ ID NO: 2845 - protein, 122 aa, Rattus norvegicus
GEADVILDCLGFKWELHHPQIFQSETLAKLYLTALIQNTKSSQRDLEKILKVHSTERMKKRSPVKKIIISLRINDPAVTRVAFALALKNLYMNEVEMTVDNVLGVLASAHILQFNRLFRKCV

SEQ ID NO: 2846 - protein, 130 aa, Rattus norvegicus
KPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYI

SEQ ID NO: 2847 - protein, 48 aa, Rattus norvegicus
LWGNEKTMNLNPMILTNILSSPYFKVQLYELKTYHEVVDEIYFKVTHV

SEQ ID NO: 2848 - protein, 298 aa, Rattus norvegicus
MKYLLDLILLLPLLIVFCIESFIKRLIPKKKKSVAGEIVLITGAGHGIGRLTAYEFAKLNTKLVLWDINKNGIEETAAKCRKLGAQVHPFVVDCSQREEIYSAVRKVKEEVGDVSILVNNAGVVYTADLFATQDPQIEKTFEVNVLAHFWTTKAFLPAMMKNNHGHVVTVASAAGHTVVPFLLAYCSSKFAAVGFHRALTDELAALGCTGVRTSCLCPNFINTGFIKNPSTNLGPTLEPEEVVEHLMHGILTNQKMIFVPGSIALLTVLERVFPERFLDVLKRRINVKFDAVVGYKDK

SEQ ID NO: 2849 - protein, 253 aa, Arabidopsis thaliana
MAEELEKSMHKEESLMEKIADKIHDHDSSSSSDSEHEKPESPSALKAKIYRLFGREKPVHKVLGGGLPADVFLWRDKKLSASVLGVATAIWVLFELVEYHFLSLVCHILIFALAALFLLSNAHAFMNKTPPKIPEIHIKEEHFLMIVSALRNELNQAFVILRSIALGRDLKKFLMVVFGLWIISVVGNWFNFLTLVYICFVVLHTVPMLYEKHEDKVDPVAEKTLKELKKHYMVFDEKVLSKLPVASLKAKLG

SEQ ID NO: 2850 - protein, 435 aa, Arabidopsis thaliana
MVGGKKKTKICDKVSHEEDRISQLPEPLISEILFHLSTKDSVRTSALSTKWRYLWQSVPGLDLDPYASSNTNTIVSFVESFFDSHRDSWIRKLRLDLGYHHDKYDLMSWIDAATTRRIQHLDVHCFHDNKIPLSIYTCTTLVHLRLRWAVLTNPEFVSLPCLKIMHFENVSYPNETTLQKLISGSPVLEELILFSTMYPKGNVLQLRSDTLKRLDINEFIDVVIYAPLLQCLRAKMYSTKNFQIISSGFPAKLDIDFVNTGGRYQKKKVIEDILIDISRVRDLVISSNTWKEFFLYSKSRPLLQFRYISHLNARFYISDLEMLPTLLESCPKLESLILEMVKNQSTRRHGEKREPNVMVSTVPWCLVSSLKFVELKRSIPRYEGEMELVRYVLTNSTVLKKLRLNVYYTKKAKCAFLTELVAIPRCSSTCVVLVL

SEQ ID NO: 2851 - protein, 292 aa, Danio rerio
MAAPFKTLVEDYPRYLKSFELFLERSSEHQCMQDFIHNTLPDILASIGGGRSVFNVMGVGSGAGDIDLEMLAQLHLKHPHVKVDNEVVEPSNDMLYKYKARVSTSPDLAYINFTWNKMTASEFEKQWQEKTPEKKMDFIHMIQMLYYVKDPNATVSFFRSLLEKDGKLLIILVSGESGWGKLWTTFRKQLCYTEMSQCVTIGEIKSFLDSEGVPYRKYVLLSQMDITECFTEGDQEGELLLDFLTEVKEFSKNAPERLKKEVLDVLRHPDCSKEVDGRIIFNNNLEVLVIEP

SEQ ID NO: 2852 - protein, 550 aa, Xenopus laevis
MQQQKGEEVYYVGIDVGTASVRVALVDQFGTVVDQVEQSIKIWEPQPDHYEQSSDDIWAACCQVTKQVVRTKDPRCIRGLGFDATCSLVVLDTQFQPLAVNSQGEHKRNIIMWMDHRAGCQVDRINRTNHKVLRYVGGVMSVEMQPPKLLWLKENLREECWNKSGQLFDLPDFLTWKATGDNTRSFCTLVCKWTYSLDHGWDDSFWKEIGLEDICEGNYVKIGNQVMSPGASIGNCLTATAAKELGLPEGLPVAASLIDAHAGGLGVIGASLKEYGLEGENHPITSRLALICGTSSCHMGISEKPIFVPGVWGPYYSAMIPGLWLNEGGQSATGKLIDHVVHGHIAFMELENQAKARGQHIYTYLNNHLDKIKKSGPVGFLAADLHVWPDFHGNRSPLADLTMKGMVVGLTLSKSLDDLATLYLATIQAIALGTRHILETMQTAGHHISTLYLCGGLSKNPLFVQMHADITGLPVVLSKEVESVLVGAAILGACASGDFPSIKEAMEKMSKVGKIIFPNHEDKRFYDKKYEVFLKLSSHQKEYQAIMGRM

SEQ ID NO: 2853 - protein, 81 aa, Xenopus laevis
HMDLPGLAEYPDIFAVCLIILLAGLLSFGVKESTAVNKVFTAINILVLLFVIASGCVTGNLKYWKMSKEDLWATKQSVSNH

SEQ ID NO: 2854 - protein, 42 aa, Xenopus laevis
FTAINILVLLFVIASGCVTGNLKYWKMSKEDLWATKQSVSNH

SEQ ID NO: 2855 - protein, 410 aa, Xenopus laevis
MARLSYVRIKYLFFSWLAVFIGSWVIYVRYNSYTELCRGQECKTAICDKYRKGIIDGSACEGLCEKETIYFGKCLSAKPNNQIYLGIWGNLEGVIKCQMENTLHLDFGVDLEPRKEIVLFDKPTRGTTVQKFKEMVHSLVKKRLGDQGNLQDLVNLILKAADSNKDGHVSLPEAKSAWALLQLNEFLLMVILQDKEHTPKLLGYCGDLYITERVPYTSLYGISLPWIIEVFIPMGLRKRMDQWFTPSWPRKAKIVIGLLEFVEDIFHGLYGNFLMCDVSAKNFGYNDKYDLKMVDMRKIIPEMSLKEYIKYKSCESDSDCVYGADCGTTCDQSKRCTTDVTQPNLAKVCLLVKDYLLSGTPSEIRDELEKQIYSCIALKAATKHMEMEHALILNNLKALLWKKISHTNDS

SEQ ID NO: 2856 - protein, 94 aa, Xenopus laevis
KKAADKNIPCRPLVCAVLDLMVEFIVTHMMKDFPMDLYTRCIQIVHKVLCYQKKCRVRLHYTWRELWLALINLLKFLMSNETVLLAKHNIFTLT

SEQ ID NO: 2857 - protein, 57 aa, Xenopus laevis
IQIVHKVLCYQKKCRVRLHYTWRELWLALINLLKFLMSNETVLLAKHNIFTLTLMVV

SEQ ID NO: 2858 - protein, 94 aa, Xenopus laevis; identical to SEQ ID NO: 2856

SEQ ID NO: 2859 - protein, 57 aa, Xenopus laevis; identical to SEQ ID NO: 2857

SEQ ID NO: 2860 - protein, 39 aa, Xenopus laevis
ILVVLTKRDVSVLYAVRYENSSLKADIKSSGLIHCACWT

SEQ ID NO: 2861 - protein, 144 aa, Xenopus laevis
LYWGPFLANDTPALLAVQHKKHVTVWQLCYSPSDKNKLVVSQTCEIGDPFPVLPQGCTWHPSKDILVVLTKRDVSVLYAVRYENSSLKADIKSSGLIHCACWTKDGSRLVVAIGSALHSYIWDSKQKTLNACAFCPVFDIGGYI

SEQ ID NO: 2862 - protein, 30 aa, Xenopus laevis
WKCSKLLMKFIHAGLHLTALIFTIVALVAV

SEQ ID NO: 2863 - protein, 53 aa, Xenopus laevis
KCSKLLMKFIHAGLHLTALIFTIVALVAVFDFHNAKNIPNMYSLHSWIGLTVV

SEQ ID NO: 2864 - protein, 71 aa, Xenopus laevis
IEDWLYKIPMISLFVRVMLTVGLSILKHHTEHQKDMKTLLPKCTGMKNTSFVSLLDLPAVMHLNYYLPYEV

SEQ ID NO: 2865 - protein, 31 aa, Xenopus laevis
WLYKIPMISLFVRVMLTVGLSILKHHTEHQK

SEQ ID NO: 2866 - protein, 182 aa, Xenopus tropicalis
MLVLVLGDLHIPHRCNSLPAKFKKLLVPGKIQHILCTGNLCTKESFDYLKTLAGDVHIVRGDFDENLNYPEQKVVTVGQFKIGLIHGHQVIPWGDMASLALLQRQLDVDILISGHTQKFEAFEHENKFYINPGSATGAYNALENNIIPSFVLMDIQASTVVTYVYQLIGDDVKVERIEYKKS

SEQ ID NO: 2867 - protein, 658 aa, Xenopus laevis
MKLYCLSGHPTLPCNILKFKSSTIMLDCGLDMTSTLSFLPLPLVHSTRLSKLPGWVTKDGNNQFEKELKECSGRVFVDSVPEFCLPETELIDLSTVDVILISNYHCMMALPYITERTGFTGTVYATEPTVQIGRLLMEELVNFIERVPKAQSATVWKHKDVQRLLPAPLKDAVEVFTWKKCYSMQEVNAALSKIQLVGYSQKIELFGVVQVTPLSSGYALGSSNWVIQSHYEKVSYVSGSSLLTTHPQPMDQTSLKNSDVLILTGLTQIPTANPDGMVGEFCSNLAMTIRSGGNVLVPCYPSGVIYDLLECLYQYIDSAGLSNVPFYFISPVANSSLEFSQIFAEWLCHNKQNKVYLPEPPFPHAELIQSNKLKHYPNIHGDFSNDFKQPCVVFTGHPTLRFGDVVHFMELWGKSSLNTVIFTEPDFSYLDALAPYQPLAMKCVYCPIDTRLNFIQVTKLLKEVQPLHVVCPEQYTQPPATQSHRSDLMIDCQPPPMSYHRAEVLTLPFKRRYEKIEIMPELAQSLVPFEMKPGVSLATVSAVLHSKDNKHVLQPPPKPVAPPGSKKRKRPAEESPETPPFKPLLSGSIPVEQFVQTLEKNGFSDVKIEDTAKGHIVHLQEAETLIQFEEDSTHIICEHDERLRVRLRDLVLKFLQKF

SEQ ID NO: 2868 - protein, 155 aa, Mus musculus
WLENKVLPLLEDQEEEYLKLRKDVYQQIIQTYLAVCKDVVMVGLGDPKFQMQLLQRSFGIMKTVKGFFYVSLLLGILKEIAGNTIIHKTDSDEKVTVLFDLVQEVFQKMLECIACIFRKQPEESLPLFHSVQTPLHEFITTIQSWHKDTAVHHAV

SEQ ID NO: 2869 - protein, 134 aa, Mus musculus
LAVCKDVVMVGLGDPKFQMQLLQRSFGIMKTVKGFFYVSLLLGILKEIAGNTIIHKTDSDEKVTVLFDLVQEVFQKMLECIACIFRKQPEESLPLFHSVQTPLHEFITTIQSWHKDTAVHHAVLSTLIAAPVVE

SEQ ID NO: 2870 - protein, 68 aa, Danio rerio
HKKSMVGMSSKAVLWRCFSTIVIFLYLLDEQTSLLVLVPAGIGSLIEVWKVKKAFKIHVIWRGLTPTF

SEQ ID NO: 2871 - protein, 88 aa, Danio rerio
HKKSMVGMSSKAVLWRCFSTIVIFLYLLDEQTSLLVLVPAGIGSLIEVWKVKKAFKIHVIWRGLTPTFLFGKLDESEKRTEEYDTLAM

SEQ ID NO: 2872 - protein, 334 aa, Xenopus tropicalis
MPEPVKVLVTGAAGQIAYSLLYGIAKGDVFGKDQPLILVLLDITPMMTVLEGVVMELQDCALPLLKEVIATDKEDVAFKDLDVAILVGSMPRREGMERKDLLKANVKIFKSQGAALNKYSKKSVKVIVVGNPANTNCLTAMKSAPSIPKENFSCLTRLDHNRAKGQIALKLNVASDDVKNVIIWGNHSSTQYPDASHATVNLQGKDVGAFEAVKNDDWLKGEFITTVQQRGAAVIKARKLSSAMSAAKAICDHVRDIWFGTPDGQFVSMGVISDGNSYGIPEDLMYSFPLTIKNKTWKIVEGLPINDFSREKMDLTAKELHEEKETALEFLSCE

SEQ ID NO: 2873 - protein, 374 aa, Xenopus tropicalis
MSVPAFIDVTEEDQAAELRAYLKSKGAEISEENSEGGLHIDLAQIIEACDVCLKDDDKDVESSMNSVVSLVLILETDKQEALIESLCEKLVKFREGERPSLRLQLLSNLFHGMDKSIPARYTVYCGLIKVAATCGAIIYIPTDLDQVRKWISDWNLSTEKKHIVLRLLYEALVDCKKSDEAAKVMVELLGSYTDDNASQARLDAHKCIVRALKDPKAFLLDHLLALKPVKFLEGELIHDLLTIFVSAKLSSYVKFYQNNKDFIDSLGLSHEQNMEKMRLLTFMGMAVDNKEISFDTIQQELQIGADEVEAFIIDAVKTKMVYCKIDQTQKRVVVSHSTHRTFGKQQWQQLYDTLNTWKQNLNKVKNSLYSISDA

SEQ ID NO: 2874 - protein, 708 aa, Caenorhabditis elegans
MIGWTHVCVSALILRKYGPEVLEEILRKAGYQEDIKFDIQCYYDDTETMRIFRVAATVLGLSVDDMWEMYGEFLITHACETGWQKMLFCMANNLQEFLDNLNSMHYFIDQIAFKSEMKGPTFQCEPFGESGLKLHYFSFRQGLFPIVKGLVRKTARTLFEMDVKVCMLERNQERRKSGMVEHVIFSVEPDDNHRKGKRLFHKFRNTKTTENAPSFTLSSTILVGLRDFKNIFPYHVCFNKQMIIEHIGIYLLREYGLENKKTLKVSDLMQLVQPSDIQLTYKNVLSYLNTLFIFQLKHHSKRNEVQEGSSEAFQQPLVLKGEMMPINDGNSIIFICSPHVTTVRDILNLKLYISDMPMHDATRDLVMLNQSRICQMELNKKLEETMKKMKKMTEELEVKKSQTDRLLFEFVPPVIAEALRAAKTVPAQEFSDCSVIFTDIPDFFTISVNCSPTEIITVVTDLFHRFDRIIEKHKGYKVLSLMDSYLIVGGVPNANQYHCEDSLNLALGLLFEAKQVVVPKLERSVRLRIGVHCGPVVAGIVSQQKPRFCVLGNTVNVTKSICSHSSPGKVLVSNAVRTMVTKHLKSIFVFNANGYLELQSGKVLTHFLEKNEKCSVWDIVDRDKATNDSIDGYRELHSDNGTEEWQEATVAAYRVISVVDALENKQSRTRKALTRLRSVKRKFRTIQSNDSGVSVSEPNVESAVCSIM

SEQ ID NO: 2875 - protein, 170 aa, Danio rerio
MAAGFNWFLVLSSVFLCNLVKTFLPSISSFLSKIFHKDADQEMEMRTEIQNMKMELSTISMMDEFARYARLERKINKMTDQLKTLVKSRTAQQAKMKWIVNIAFYILQAALMISLILKYYADPVTVVPSKWIAPLERLVAFPSGVAGGVGITCWLVVCNKVVALILQAVS

SEQ ID NO: 2876 - protein, 35 aa, Rattus norvegicus
LVSCGVKHIKFWSLCGNALTPKRGVFGKTGDLQTI

SEQ ID NO: 2877 - protein, 190 aa, Rattus norvegicus
AISLGHGHILVGTKNGEILEVDKSGPVTLLVQGHMEGEVWGLATHPYLPICATVSDDKTLRIWDLSPSHCMLAVRKLKKGGRCCCFSPDGKALAVGLNDGSFLMANADTLEDLVSFHHRKDVISDIQFSPGSGKYLAVASHDSFVDIYNVTSSKRVGVCKGATSYITHIDWDSRGKLLQVNTGAKEQLFF

SEQ ID NO: 2878 - protein, 35 aa, Rattus norvegicus; identical to SEQ ID NO: 2876

SEQ ID NO: 2879 - protein, 190 aa, Rattus norvegicus; identical to SEQ ID NO: 2877

SEQ ID NO: 2880 - protein, 35 aa, Rattus norvegicus; identical to SEQ ID NO: 2876

SEQ ID NO: 2881 - protein, 190 aa, Rattus norvegicus; identical to SEQ ID NO: 2877

SEQ ID NO: 2882 - protein, 35 aa, Rattus norvegicus; identical to SEQ ID NO: 2876

SEQ ID NO: 2883 - protein, 190 aa, Rattus norvegicus; identical to SEQ ID NO: 2877

SEQ ID NO: 2884 - protein, 548 aa, Gallus gallus
  MOD_RES (239)..(239): Any amino acid
MALHVPKAPGFAQMLKEGAKHYSGLEEAVYRNIQACKELAQTTRTAYGPNGMNKMVINHLEKLFVTNDAATILRELEVQHPAAKMLVMASHMQEQEVGDGTNFVLVFAGVLLELAEDLLRMGLSVSEVIEGYEKACKKALEILPDLVCCSAKNLRDVDEVASLLHTSVMSKQYGNESFLSKLIAQACVSILPDSGHFNVDNIRVCKIVGAGVSASSVLHGMVFNKETEGDVTSVKDAKXAVYSCPFDGMITETKGTVLIKNAEELMNFSKGEENLMDLQVKAIADSGANVVVTGGKVADMALHYANKYNLMIVRLNSKWDLRRLCKTVGATALPRLTPPTLEEMGHCNSVYLSEVGDTQVVVFKHEKEDGAISTILIRGSTDNLMDDIERAVDDGVNTFKVLTRDKRLVPGGGATEIELAKQITSYGETCPGLDQYAIKKFAEAFEAIPRALAENSGVKANEVISKLYAVHQEGNKNVGFDIEAEAAAVKDMLEAGILDTYLGKYWGIKLATNAAVTVLRVDQIIMAKPAGGPKPPSGKKDWDEDQND

SEQ ID NO: 2885 - protein, 245 aa, Felis catus
MDDTSTLTDVKEYPDTEVQKNRVLTLEEWREKWVDGKIGFHQEQGHQLLKKHLDTFLKGENVLRVFFPLCGKAVEMKWFADRGHCVVGVEISELGIREFFTEQNLSYSEEPIMEIPGAKVFKSSSGNISLYCCNLFDLPRVNIGKFDRIWDRGALVAVNPGDRKCYTDIMLSLTRKGFRYLLAVLSYDPTKHPGPPFYVPDAEIKNLFGSTCNIHCLEKVDVFEERHKSWGIDYIVEKLYLLTEK

SEQ ID NO: 2886 - protein, 234 aa, Bartonella henselae
MNVQQLKKMAALKALEFVEDDMRLGIGSGSTVNEFIPLLGERVANGLRVTCVATSQYSEQLCHKFGVPISTLEKIPELDLDIDGADEIGPEMTLIKGGGGALLHEKIVASASRAMFVIADETKMVKTLGAFALPIEVNPFGIHATRIAIEKAADNLGLSGEITLRMNGDDPFKTDGGHFIFDAFWGRILQPKLLSEALLAIPGVVEHGLFLGLASRAIVAMADSQIKVLEPFDF

SEQ ID NO: 2887 - protein, 328 aa, Staphylococcus aureus
MADLLNVLKDKLSGKNVKIVLPEGEDERVLTAATQLQATDYVTPIVLGDETKVQSLAQKLNLDISNIELINPATSELKAELVQSFVERRKGKTTEEQAQELLNNVNYFGTMLVYAGKADGLVSGAAHSTGDTVRPALQIIKTKPGVSRTSGIFFMIKGDEQYIFGDCAINPELDSQGLAEIAVESAKSALSFGMDPKVAMLSFSTKGSAKSDDVTKVQEAVKLAQQKAEEEKLEAIIDGEFQFDAAIVPGVAEKKAPGAKLQGDANVFVFPSLEAGNIGYKIAQRLGGYDAVGPVLQGLNSPVNDLSRGCSIEDVYNLSFITAAQALQ

SEQ ID NO: 2888 - protein, 337 aa, Xenopus laevis
MDLDVLNMFLVAGGTLLVPILAFVTSFLLWPAALIKIYYWYWRRALGMQVKFSSYGNYKFCYTSRGKPGNKASVLMLHGFSAHKDMWLSVVKFLPKNLHLVCVDMPGHEGTTRSALDDYSICGQVKRIHQFVESIGLNKRTFHLVGTSMGGNVAGVYAAQHPTDISSLTLICPAGLMYPTESKFLKHLKGLEKSGDDQRILLIPSTAGEMEDMLRLCSFVRFKIPQQVLQGLVDVRIPHNEFYRQLFMALVNEKSRHSLQENMNKIVAPTQIIWGKQDQVLDVSGAEVLAGSIRGCQVEILENCGHSVVMERPRKSAKLMTDFLSSLQSTENNKKHE

SEQ ID NO: 2889 - protein, 327 aa, Xenopus laevis
MATSVEYETLYTGQKMPLIGLGTWKSAPGQVKDAVKYALGVGYRHIDCAFVYGNETEVGEAIKESVGPDKGLKREEVFVTSKLWNNKHHPDDVECALRKTLQELQLDYLDLYLMHWPYAFKRGDQVFPQNPDGSVQYDLTDYKDTWKAMEKLVEKGLAKAIGLSNFNKRQMDDILSIATVKPAVLQVECHPYLAQNELIACCRSHGLVLTGYSPLGSPDRSWRKPEDPVLLEEPGIIAMAKKYNISEAQILLRWQVQRRVVTIPKSVTPARILQNLQVFDFSLSEEEMQLIGALNKNWRYIIPLITVNGKSVPRDAGHPLYPFNDPY

SEQ ID NO: 2890 - protein, 182 aa, Xenopus laevis; identical to SEQ ID NO: 2866

SEQ ID NO: 2891 - protein, 414 aa, Xenopus laevis
MDVNQPKQEHLLALKVMRLTKPTLFTNIPVTCEEKDLPGDLFSTLMKDDPSTVKGAEILMLGEMLTLPQNFGNIFLGETFSSYISVHNDSNQVVKDVQVKADLQTSSQRLNLSASSAVVADLKPDSCIDDVIHHEVKEIGTHILVCAVSYTIQSGEKMYFRKFFKFQVLKPLDVKTKFYNAETDEVFLEAQIQNITTSPMFMEKVSLEPSIMYNVSELNTVITNGDWKGSSTFGTKTYLQPLDTRQYLYCLKPKPEFAEKAGVIKGVTVIGKLDIVWKTNLGERGRLQTSQLQRMAPGYGDVRLSIETIPDTVRLEEPFDITCKITNCSSERTMDLVLEMCNTNAIHWSGVSGRQLGKLHPSSSLHLTLTLLSSVQGLQSVSGLRLTDTFLKRTYEYDDIAQVCVVSSKLQAES

SEQ ID NO: 2892 - protein, 437 aa, Xenopus laevis
MSGLARLQRLQKFGFLMVSASANRPIQRYQCSRTEKPQKRTSANALLNHLIFKIKSTGPITVSEYMREVLTNPVKGYYMHNDMLGEHGDFVTSPEISQIFGELLGVWCISEWVSAGKPKAIQLVELGPGRGTLTDDLLRVFSNFGRLLDSCDISVHLVEVSPKLSDIQAQRLTGKSIEVELDSNSPVYKNGITKTGRPVCWYQDIQDVPNGYSFYIAHEFFDALPIHKLQKIKDGWREMLIDIDPKLPDKLRFVLGSNMSLVAKTFVQDDEPRDHVEVCPSAAVIIQKLAQQINSYGGAALIADYGHMGEKTDTFRGFRAHQLHDVLTDPGTADLTADVDFNFMRRMVGEAASCLGPVTQHVFLKNMGIDIRLKVLLEKSNDVTVQKQLIHGYNVLMNPDQMGQRFKFFSVVPHSRLKNTLKTKMPPVAGFSTLLMT

SEQ ID NO: 2893 - protein, 336 aa, Rattus norvegicus
MLGTVNTTGMQGFNKSERCPRDTRMTQLLFPVLYTVVFFTGVLLNTLALWVFIHIPSNSTFIIYLKNTLVADLIMTLMLPFKILSDSRLAPWQLRGFVCTFSSVVFYETMYVGIMMLGLIAFDRFLKIVVPFRKTFVKKTAFAKIVSISIWLLMFLISLPNMILNKEATASTVKKCASLKSPLGLLWHQVVSHTCQFIFWTVFILMLLFYTVIAKKVYDSYRKFKSRDSKHKRLEAKVFIVMAVFFVCFAPFHFVRVPYTHSQTTNKTDCRLENQLFLAKESTLFLATTNICMDPLIYIILCKKFTRKVPCMRWRTKTAASSDEHHSSQTDNITLS

SEQ ID NO: 2894 - protein, 89 aa, Rattus norvegicus
ETMYVGIMMLGLIAFDRFLKIVVPFRKTFVKKTAFAKIVSISIWLLMFLISLPNMILNKEATASTVKKCASLKSPLGLLWHQVVSHTCQ

SEQ ID NO: 2895 - protein, 55 aa, Rattus norvegicus
ILNKEATASTVKKCASLKSPLGLLWHQVVSHTCQFIFWTVFILMLLFYTVIAKKV

SEQ ID NO: 2896 - protein, 332 aa, Mus musculus
MLLLAAAGLVAFVLLLYMVSPLISPKPLALPGAHVVVTGGSSGIGKCIAIECYKQGAFITLVARNEDKLLQAKKDIEKHSINDKQVVLCISVDVSQDYNQVENVIKQAQEKLGPVDMLVNCAGTSMSGKFEELEVSSFEKLMSINYLGSVYPSRAVITTMKERRVGRIVFVSSQAGQLGLFGFTAYSSSKFAIRGLAEALQMEVKPYNVYVTVAYPPDTDTPGLAEENKTKPLETRLISETTAICKPEQVAKQIVKDAIQGNFNSSIGSDGYMLSSLTCGMAPVTSITEGLQQVVTMGLFRTIALFYLGSFDNIVRRCMVQKAKPEVVDKTA

SEQ ID NO: 2897 - protein, 147 aa, Macropus eugenii
MVHLTAEEKNAITSLWGKVAIEQTGGEALGRLLIVYPWTSRFFDHFGDLSNAKAVMSNPKVLAHGAKVLVAFGDAIKNLDNLKGTFAKLSELHCDKLHVDPENFKLLGNIIVICLAEHFGKEFTIDAQVAWQKLVAGVANALAHKYH

SEQ ID NO: 2898 - protein, 530 aa, Oryza sativa
MNHCLVVSHKKLQTFRTFAASKFSSFTKSAQKSIKYSFQFIYQNNPLFVHVAYFALISFAGYGSLKVLKPRDKSNTLKDLDVLFTSVSASTVSSMATVEMEDFSSAQLWVLTILMLIGGEVFTSMLGIHFMRAEFGTKESVSTRDHSPCIDIESITSTKFGPSTQGTKVTVSFSELRMENGGHVEPKTIKFLGFVVMGYLLITNLGGSLLIYLYLNLVPSAHKILKRKGIGIIVFSVFTAISSVGNCGFTPVNENMIIFQKNSILLLLILPQILAGNTLFAPCLRLMVWSLEKITGKKDCRYILEYPKAIGYKHLMSTRESVYLTLTVVSLIILQTVLFLSLEWSSVALDGMSNYQKIVSALFQSVNARHAGESVTDLSNLSSAILVLYTIMMYLPGYTSFLPRHDGEDSKTEKINKRKGLLENWIFSHMSYLAIFVMLICITERDSMATDPLNFNVFSILFEVVAYGNVGFSVGYSCKRLLNHDARCKDASYGFAGKWSDNGKAILIIVMLFGRLKTFNMKGGRAWKLR

SEQ ID NO: 2899 - protein, 147 aa, Auxis rochei
MADFDAVLKCWGPVEADFNTVGGMVLARLFKDHPDTQKLFPKFAGIAAGDLAGNAAVAAHGGTVLKKLGELLKAKGNHAAIIKPLANSHATKHKIPINNFKLITEALVHVMQEKAGLDAAGQTALRNVMGIVIADLEANYKELGFTG

SEQ ID NO: 2900 - protein, 720 aa, Xenopus laevis
MAALSEHFTLCGLLTGTDDGKSEILGVEPAGEPDRVLVTDSVQAVTLYKVSDQKPQGAWAVKQGQSITCPAVLNPESGEFIVVHDDKVLRIWKEDNVNLDIAFKATLSADVCRIHTLPNTDPLVLFKGGAVHFLDSLLTDPQQKIGTVLSDGERIVWSEIFADDGQPLIVYLTQQFSNYFVYIHKFSPVCVCKYHLKPNTEDSTILDCSGSVKSKIFTLLTLYSSGQVCQTPFPVSLINKETERVVSASPLLQLSGPIEVGALNFLDESHVAVLISSSSEQKECLSIWNTTFQTLQAARNFQQRTSAQLWCYDNKLFVPHGKTLVVVPYVCEASCLASVLGKSRNIQTSVLENVPFVNWDKLVGKDPETKPSNAGAQKKTRERKTNANAGNGTESILYPFDVQNISQTQTEAFVQQLLLGKEDTDFQITVGKITQGLVKRCMADPKFYPQSSFVQLVQTNTLSYSLCPDLLSLFLEKRDVPLLQLCLHSFPDVPEVILCSCLKAFLSISEKLVNAAQINTELASLYIDVGDKDKEHKYTEHPEEPSVLQNGFSPTALEEDSCDELIAESLPQTTQKATCPISIKRAVLVNSILISPYNESFLLPHLKDMSGDQVMFFLRYLLYLYLKFNENITINHPGKQMPTVSQIVDWMSMLLDAHFATVVMLSDAKALLNKIQKTVKSQLKFYSEMNKIEGCLAELKELKCPARVSARYSIEVLQLY

SEQ ID NO: 2901 - protein, 445 aa, Xenopus laevis
MITGKITCLHITDVRFPTSLDQHGSDAMHTDPDYSAAYVVIETDAADGLKGHGLTFTLGKGTEVVVCAVRALSRHVIGKALEDIVNNFRDFYRQLTSDGQLRWIGPEKGAVQLATAAVLNAVWDLWAKKEKKPLWKLLVDMDPHQLVSCIDFRYITDALTEEEALKILQNGKQGQRDREEHMLTSGYPAYTTSCAWLGYSDEQLKKLCSDALKEGWTRFKVKVGADLKDDIRRCELIRDMIGPDNIMMLDANQRWDVQEAISWVKDLAKYKPLWIEEPTSPDDILGHATISKELSPVNIGVATGEQCHNRVMFKQFLQAKALQYLQIDSCRLGSVNENLSVLLMAKKFNVPVCPHAGGVGLCELVQHLILFDYICVSGSLDNRMCEYVDHLHEHFTYPVIINRAAYMPPKDPGYSTEMKEESVLQYQFPDGAVWKKLILEKKVEV

SEQ ID NO: 2902 - protein, 234 aa, Danio rerio
MANLCKRVVDLEKYIVKEAPPTVYYIPDFISEAEEEFLLQQVYRAPKPKWTQLSGRRLQNWGGLPNPKGMLAEKLPDWLLEYTEKISALGAFAGKTANHVLVNEYKPGEGIMPHEDGPLYHPTVTTITVGSHTLLDFYRPVCQAEPDAPQTEESRYMLSLLVQRKSLLILQDDMYKCYLHGIRGVCEDVLSEHVVNISSTGAQVGDTLPRSTRVSLTIRHVPKIIRANLFLGKK

SEQ ID NO: 2903 - protein, 535 aa, Rattus norvegicus
MVKKVAVIGAGVSGLISLKGCVDEGLEPTCFERTEDIGGLWRFKENVEDGRASIYHSVITNTSKEMSCFSDFPMPEDFPNFLHNSKLLEYFRIFAKKFDLLKYIQFQTTVISVKKRPDFASSGQWDVYVQSNGKEQRAVFDAVMVCSGHHIQPHLPLKSFPGIERFQGQYFHSRQYKHPVGYEGKRILVVGIGNSAADIASELSKRAAQVFVSTRHGSWVLSRISEDGYPWDMVFHTRFSSMLRNVLPRTVVKWMMERQMNRWFNHENYGLVPQNKYLMKEPVLNDDLPSRLLYGAIKVKTRVKELTETAVVFEDGTVEEDVDVIVFATGYTFSFPFLEDSLVKVEDNKVSLYKAMFPPHLEKPTLACIGLIQPLGSIFPTVELQARWATRVFKGVCRLPSETTMMADIAERNEKRIDLFGKSQSQILQTNYIDYLDELALEIGAKPDFISLLFKDPKLAVKLYFGPCNSYQYRLVGPGQWEGARNAILTQKQRILKPLKTRTLQTSASAPVSFLIKVLGLLAIVLAFFFKLHGF

SEQ ID NO: 2904 - protein, 391 aa, Brassica oleracea
MAMAAAAVIVPLGILFFISGLVVNLLQAVCYVLIRPLSKNTYRKINRVVAETLWLELVWIVDWWAGVKIQVFADDETFNRMGKEHALVVCNHRSDIDWLVGWILAQRSGCLGSALAVMKKSSKFLPVIGWSMWFSEYLFLERNWAKDESTLKSGLQRLNDFPRPFWLALFVEGTRFTEAKLKAAQEYAATSQLPVPRNVLIPRTKGFVSAVSNMRSFVPAIYDMTVAIPKTSPPPTMLRLFKGQPSVVHVHIKCHSMKDLPESEDEIAQWCRDQFVAKDALLDKHIAADTFPGQKEQNIDRPIKSLAVVVSWACLLTLGAMKFLHWSNLFSSLKGIALSALGLGIITLCMQILIRSSQSERSTPAKVAPAKPKDKHQSGSSSQTEVEEKQK

SEQ ID NO: 2905 - protein, 21 aa, Lotus japonicus
WTFLLVVIFSFMIFKVTKTHL

SEQ ID NO: 2906 - protein, 75 aa, Lotus japonicus
LANTIVIPVTCPTIACEFLKKHDASFASRPKIMSTDIASDGFITTVLVPYGEQWKKMKRVLVNNLLSPQKHQWLL

SEQ ID NO: 2907 - protein, 422 aa, Oryza sativa
MVRGSLGKLASRALSVAGKWQHQQLRRLNIHEYQGAELMGKYGINVPRGAAAGSVEEVKNTLKNVFPSEKEIVVKSQILAGGRGLGTFKSGLQGGVHIVKAEEAESLAAKMLGQILVTKQTGPQGKIVSKVYLCEKLSLVNEMYFAITLDRNTAGPLIIACSKGGTSIEDLAEKYPDMIIKVPIDVFKGITDDDAAKVVDGLAPKTADRQSSIEQIKKLYELFCKSDCTLLEINPLAETADNKLVAADAKLNFDDNAAFRQKEIFAMRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 2908 - protein, 36 aa, Mus musculus
EQHLNELMTKKWLLGSNAVDIICVTVEDYFNDFAKI

SEQ ID NO: 2909 - protein, 33 aa, Mus musculus
HLNELMTKKWLLGSNAVDIICVTVEDYFNDFAK

SEQ ID NO: 2910 - protein, 129 aa, Schizosaccharomyces pombe
CSVHAQLYPYVSDCMVMHRKAPINEQEALRDVVWETRTINKKLHVTPIKPNITSILLVSKPGDEEVEEKLKEFVYWLISLDNITVFIQKSMEDLFEKTEKIQYWTTLLCTKHSQLFDLVLTLGGDGTVL

SEQ ID NO: 2911 - protein, 147 aa, Gorilla gorilla
MVHFTAEEKAAVTSLWSKMNVEEAGGEALGRLLVVYPWTQRFFDSFGNLSSPSAILGNPKVKAHGKKVLTSFGDAIKNMDNLKPAFAKLSELHCDKLHVDPENFKLLGNVMVIILATHFGKEFTPEVQAAWQKLVSAVAIALAHKYH

SEQ ID NO: 2912 - protein, 147 aa, Pan troglodytes; identical to SEQ ID NO: 2911

SEQ ID NO: 2913 - protein, 414 aa, Plasmodium falciparum; identical to SEQ ID NO: 1816

SEQ ID NO: 2914 - protein, 45 aa, Arabidopsis thaliana
DSNLTYAPVVEKIPSMLLEIKKAIQTVYLYGGRKFWVHNTGPLGC

SEQ ID NO: 2915 - protein, 42 aa, Arabidopsis thaliana
LTYAPVVEKIPSMLLEIKKAIQTVYLYGGRKFWVHNTGPLGC

SEQ ID NO: 2916 - protein, 388 aa, Arabidopsis thaliana
MGNCCGTAGSLAQNDNKPKKGRKKQNPFSIDYGLHHGGGDGGGRPLKLIVLNDPTGREIESKYTLGRELGRGEFGVTYLCTDKETDDVFACKSILKKKLRTAVDIEDVRREVEIMRHMPEHPNVVTLKETYEDEHAVHLVMELCEGGELFDRIVARGHYTERAAAAVTKTIMEVVQVCHKHGVMHRDLKPENFLFGNKKETAPLKAIDFGLSVFFKPGERFNEIVGSPYYMAPEVLKRNYGPEVDIWSAGVILYILLCGVPPFWAETEQGVAQAIIRSVLDFRRDPWPKVSENAKDLIRKMLDPDQKRRLTAQQVLDHPWLQNAKTAPNVSLGETVRARLKQFTVMNKLKKRALRVKYILLINYPKMYISSDLKSLTIVSFGLVTLSR

SEQ ID NO: 2917 - protein, 185 aa, Arabidopsis thaliana
MAEPDSVNEAKEKKKKLWKAVFAISGIMLTLVIYGLLQEKIMRVPYGLKKEYFKHSLFLVFCNRLTTSAVSAAALLASKKVLDPVAPVYKYCLISVTNILTTTCQYEALKYVSFPVQTLAKCAKMIPVMVWGTLIMQKKYRGFDYLVAFLVTLGCSVFILFPAGDDISPYNKGRENTVWGVSLMV

SEQ ID NO: 2918 - protein, 254 aa, Arabidopsis thaliana
MLKNKKSDNSLSRDTLQIKKRKKTTMAQNGSNTTVKLIGTWASPFAIRAQVALHLKSVEHEYVEETDVLKGKSDLLIKSNPIHKKVPVLIHGDVSICESLNIVQYVDESWPSDLSILPTLPSERAFARFWAHFVDGKLFESIDAVAGAKDDAARMTLAGNLMENLAALEEAFQKSSKGGDFFGGGNIGFVDITVGAIVGPISVIEAFSGVKFLRPDTTPGLIQWAEKFRAHEAVKPYMPTVAEFIEFAKKKFSV

SEQ ID NO: 2919 - protein, 50 aa, Xenopus laevis
IKYILHSVDLQSENPWDNKAVYMLYTELFTGFIKVLLYVAFMTIMVKVHT

SEQ ID NO: 2920 - protein, 48 aa, Xenopus laevis
KYILHSVDLQSENPWDNKAVYMLYTELFTGFIKVLLYVAFMTIMVKVH

SEQ ID NO: 2921 - protein, 88 aa, Xenopus laevis
VNTLLDCVTQRNLPWKFEHIGIGFLSLLLRDDYVLPVRAIRYLVQCLNHDALIVRKMAISTVAGILKQLKRTHVKETICPYKISGCPK

SEQ ID NO: 2922 - protein, 115 aa, Xenopus laevis
TFSTILTQCSKEIFKVALEKVFNFAVSNIFETRVSGRMVADLCRAAVKCCPVESLKLFLPHCCNVISHLTINDDVMNDEELDKELLWKLQLLSEITRVDGEKLLPYKEQLVQILH

SEQ ID NO: 2923 - protein, 159 aa, Xenopus laevis
KFVIDNLLQEEADCTLLITRFQEYLEYDDVRYYTMTVTNDCVSRVQQKNKLVLPPVFQTNVFCLLSSINIPVEESALGNFLVTKNVNNEDWKPSKLKDHKRVFERVWMIFLKHQLSVSLYKKVLLILHESILPHMSKPTLMIDFLTAAYDVGGAISLLA

SEQ ID NO: 2924 - protein, 134 aa, Xenopus laevis
TMTVTNDCVSRVQQKNKLVLPPVFQTNVFCLLSSINIPVEESALGNFLVTKNVNNEDWKPSKLKDHKRVFERVWMIFLKHQLSVSLYKKVLLILHESILPHMSKPTLMIDFLTAAYDVGGAISLLALNGLFILI

SEQ ID NO: 2925 - protein, 955 aa, Xenopus laevis
MTENPFHYLVETLSGTSDKTFFNVSKLKATEYDSLPYCIRVVLEAVVRNCDGVLVKEQDAFNILNWKTKCEFKEIPFLPARVMLQDFTGIPAMVDFAAMRDAISKFGKDPKQVNPACPTDLIADHSLQLDFTKCIAAQNVSGLPAVETHRPTTTPGKTPGRKAQCRSQGGCKGACDLGAANGSSREQIENTPMLCPFHLQPIAEPETALKSLEIEFNRNKERLQFFKWCSKAFQNVAVIPPETGTVHQVNLEFLSRVVMEEKGCIYPDSVLGTDSHTTMVNGLGILGLGVGGIESEAAMLGVPITLTLPEVVGCELTGTINPIATSIDVVLSITKHLKQAGVAGTFVEFFGNGVSQLSVADRTTIANMCPEYGATVAFFPVDSVTLQHLKQTGVDLQCVKTFENYLKAVKLLRQENVQQPLYSKVLQINLNSIVPYVSGPKRPQDRISVMDMKKDFETCLKEKTGLKGFQIPEEKQNIMVPVTYGNSEYSLSHGCVVIAAVTSCTNNCNPSVMLTAGLLAKKAVEAGLTVKPYIKTSLSPGSGTVTYYLSASGVLPYLSKLGFDIIGYGCARCVGNTNPLPESIVTAIKEGELVACGVFSGNKHFEGNRCSCVCANYLASPPLVVAYALAGTVNIDLQTEPLGENAQGKKIFLQDIWPSREEVLEVEETLVIPSMFSELKLKIEKQNTRWNLLDAPESTLFPWDLRSTYIRSPPFFHKLEKIPPPIQPIERAYVLLYLGDSVTTDHMSPAGSIPRTSPAAKYLMQKNLVPREFNSYGARRGNDAVMTRGTFANMKLFNKLVGKTGPKTIHLPSGQTMDVFDAAELYQRSEIPLIIIAGKKYGLGNSRDWAAKGPFLLGVRVVIAESYEKIHKDHLVGMGIAPLQFLSGENAETLGLSGKEQYSLSLPVDLTPGHKVEIKTNTGKIFHVIAAFDNEAEVTLYKHGGILSYVARKYL

SEQ ID NO: 2926 - protein, 170 aa, Xenopus laevis
MAAPVMSALGRLQGLIRTERSLLTHVQSRCIQTTSVCLKNRAARVRVGKGDKPVTYEAAHPPHYIAHRKGWLSQHTGNLDGEGGAAERTIEDVFIRRFIFGTFHGCLANEIVIKRRANLLIICAIFIRKMPTQKFYFLIGYTETLLSFLYKCPVKLEVQTVEEKVIYKYL

SEQ ID NO: 2927 - protein, 353 aa, Xenopus laevis
MENGGRPSVGQVILLTTSSAITALFYSIYRHKYRSVQTLKEAKKFCLTDDLPAVLSDLPGKCVPYAVIEGAVTSVKEVLNSQYVENCKGVIQRLSLKEHKMVWNRTTHLWNDHEKIIHQRSNTVPFDLAPENPGESGVSVRVLRPLEAVDLGLETIYEKFHPAVQSFSNILGHYMTGERPKGVQETEEMLKIGATITGVGELVLDNKTIKLQPPKDGMLFYLSSMDYEGLLEKQEVQMRWWRILSIVFGVASCITLFFILRRKYRHYKEKQHLKNLQREFEESRARQRVQQEPQNKEEVQNPCSICLSTEKSCVFLECGHVCSCISCYQALPSPKKCPICRNFIDRIVPLYNS

SEQ ID NO: 2928 - protein, 1079 aa, Xenopus laevis
MLRAVLQANKNGVPLHKLQAEYKSVTGEPIPFKDMGFPALDAYLKSIPSVVRIEVSRVGEVTCYAVACKETARIAELVAHQRSSKKKGGHQVNCQMRLKSTAPVSHFGKPKITLRQPGFTPPQEMMIRKPVPTPPWGKGNYFGPRTFEYSPQPIPQLFGVAPMQRHLPNMNRPERKVTLPPRFQREVKSPLLPTPITDSNANHTQSYKRVVIGSGQSDLPVIQNNLKELLNKHSNGLWLSKLPQLYKETYKQDLGGEVLKQVPSWTHICTVQKLVSSGHTEIVIYATTRKQQPSTKNIQNRSNDQAKPNVPVVLSTPSSPPPLQISGSIPKDELKEKISTILTKYSNGLWYHALPKVFEDMFKQKLPIEAFNLDSLTDICTVDLISEEPFKAILYGKSAERAVQNSNPSVNNNIPQKLHDREPPLCSEEPDMTMAPPPLVIPSEASPSVLVVELNSTNDVVIRYIGRDYSAAQERMEDELKDFCSKSSTAQVRPLRVGQLVAAKAEEDAWLRAQISAIEDKKIKVCYVDYGFSETVDITKVCKLGKPFYTLPFQATKCRLAGLEAFCDDSVIIKALEAKACGKILAVEILHKSEKPLVVLYDTSGDDDININAACLKELYDRSLSLQLKANLSFSNVTVTNVCSDGTLFCQVPSKGLAKLYETLQKVDGEFQFQQVTSHLYVSLPFCGKICLYHYKGKWARVEITNVHSSRALDVHFLDSGTIASVKVSELKEIPPPLLRDLISIPPQALKCCLADLPLNIGMWTPDAVLWLRNTVLNCPECSIKVVKIDEAMNMVHIYLFTSNNFPDLERSINRRITNEELLKQKQKDVFLNMSVSSLEKGRGGGGAPASQLFPSGPCISPTSVAKKPDMQQSSPVPSFNMPPALPLPRPGEHMDVFVSVACHPGHFVCQPWQELHKLELVMDEMRLHYSTTEEKPIALEKNKLYAAKIENNWYRVLVKGILTNGLVSVYELDHGRHELVSCRKVQPLIEKFMHLPFQAITSQLAGINCEQWSEETSIVFRNHVEKKPLVALVQTIHESTHPWERRVVAYIVDTTLPDTDIWIHELMTEYLAQFSKPE

SEQ ID NO: 2929 - protein, 152 aa, Xenopus laevis
MLQLSSALAFLHKNQIIHRDLKPDNILVCKSRDGVDEPTLKVADFGLSKVCSSSGLNPEEPANVNKSFLSTACGTDFYMAPEVWEGHYTAKADIFALGVILWAMLERITITDTHTKKRLLGGYVQRGAQVVPVGEALLENPKLELLIPVKKK

SEQ ID NO: 2930 - protein, 78 aa, Xenopus laevis
FYMAPEVWEGHYTAKADIFALGVILWAMLERITITDTHTKKRLLGGYVQRGAQVVPVGEALLENPKLELLIPVKKKSM

SEQ ID NO: 2931 - protein, 152 aa, Xenopus laevis; identical to SEQ ID NO: 2929

SEQ ID NO: 2932 - protein, 78 aa, Xenopus laevis; identical to SEQ ID NO: 2930

SEQ ID NO: 2933 - protein, 621 aa, Danio rerio
MDISMYLGCSLGAALGGVIFASYKLGLLYQLFHKTERQSPRHGGESVAEVLRSHGVKFVFTLVGGHISPILVACEKLGIRIVDTRHEATAVFAADAVARLSGTVGVAAVTAGPGLTNTVTAVKNAQMAESPLLLIGGAAATLLQGRGALQDIDQMSLFKPLCKFCASVRTVREIVPTVRKALAIAQSGTPGPVFIEFPIDTLYPYHVVEKEFAPKNTPKGLMGKIIAWYLKNHLSNLFAGAWESRDLSPLPVHIPHATDDQVQRCVELVSRAKKPVILLGSQATLPPTPADDIRKALESLGIPCFLGGMSRGLLGKNSPLHIRQNRRDALKDADLVLLAGTVCDFRLSYGRVLNRRSKIIAVNRDKSQLLKNSDMFWKPTVAIQGDAGSFLLNLSKALKGHRCPEEWPQSLKEGDNVKEKANRAKADEKTERHLNPLSVLHRVDELLAEDSIIVADGGDFVGSAAYIMRPRGPLCWLDPGAFGTLGVGGGFALGAKLCRPESEVWIVYGDGSLGYTVAEFDTFTRHKTPVIALVGNDACWSQISREQVPMLGSNVACGLAFTDYHVVADGYGGKGYLIGREDESQLEDIIKKAQKECKEGKAVLLNVLIGKTNFREGSISV

SEQ ID NO: 2934 - protein, 187 aa, Xenopus tropicalis
MQTGLSLVCLVLLCSALGEAALRKTKKQAVVTDTGNSAKSDPEPVPIKTKGLKTLDRGWGEEIEWVQTYEEGLAKARENNKPLMVIHHLEDCPYSIALKKAFVADRLAQKLAREDFIMLNLVHPVADENQAPDGHYVPRVIFVDPSLTVRSDLKGRYGNKMYAYDADDIPELVTNMKKAKSYLKTEL

SEQ ID NO: 2935 - protein, 57 aa, Xenopus tropicalis
MKLQGIHSHADVGFLTILESLRFCKVGSFLKSPKFPIWVIGSETHLTVFFTKEMALV

SEQ ID NO: 2936 - protein, 61 aa, Xenopus tropicalis
MKLQGIHSHADVGFLTILESLRFCKVGSFLKSPKFPIWVIGSETHLTVFFTKEMALVAPEA

SEQ ID NO: 2937 - protein, 469 aa, Danio rerio
MLCLCLYVPVHNSDQIEVEYFESNGLPSELKSLKSLSVLLPSQEFSTYRRWRKKSLKTEEKEHDGQLDFEEFVHYLQDHEKDLKLVFKSMDRKIAGQVNANDIVNSLRDLGVHISLKQAEKVLKSMDKNGTMTIDWNEWKKYPTLQPAENIPEIILYWKHSTIFDVGESLMVPDEFTVEEHLTGMWWRHLVSGGGAGAVSRTCTAPLDRLKVLMQVHGCQGKSMCLMSGLTQMIKEGGVRSLWRGNGINVIKIAPETALKFMAYEQIKRVMGSSQETLGISERFVAGSLAGVIAQSTIYPMEVLKTRLALRKTGQYKGISDCAKHILKTEGMSAFYKGYVPNMLGIIPYAGIDLAVYETLKNTWLQRYGTENADPGVFVLLACGTVSSTCGQLASYPLALIRTRMQAQASVEGSSQVSMTGLFKQIMKTEGPTGLYRGLTPNFLKVIPAVSISYVVYEHIKSTLGVRSR

SEQ ID NO: 2938 - protein, 74 aa, Mus musculus
SLTQANVFNHCPAAESLGNDVDEWVPPTTKKVFISDILGFRVMGLRKCLDLHYSPDPKELPRKKLIKVTHKTNI

SEQ ID NO: 2939 - protein, 29 aa, Mus musculus
WVPPTTKKVFISDILGFRVMGLRKCLDLH

SEQ ID NO: 2940 - protein, 95 aa, Mus musculus
SWVEQLKEPVITKEDVDMLVDRQADAAEALFLLEKGQYQTILCVLHCIVSLQTLPMEVEEACLLHAIKAFTKVNFDSENGPIVYDTLKKIFKHTL

SEQ ID NO: 2941 - protein, 93 aa, Mus musculus
WVEQLKEPVITKEDVDMLVDRQADAAEALFLLEKGQYQTILCVLHCIVSLQTLPMEVEEACLLHAIKAFTKVNFDSENGPIVYDTLKKIFKHT

SEQ ID NO: 2942 - protein, 504 aa, Xenopus tropicalis
MEYMKGPATSSQGNILCCQCGIPIPPNPANMCVSCLRMQVDISEGIPKQVSVHFCKQCERYLQPPGTWIQCALESRELLTLCLKKLKANLSKVRLIDAGFIWTEPHSKRLKVKLTIQKEVMNGAILQQVFVVDYIVQSQMCDDCHRVEAKDFWKAVVQVRQKVLHKKTFYYLEQTILKHRLHQNTLRVKEIHDGLDFYYASKQHAQKMVEFLQCTVPCRFKASQRLISHDIHTNAYNYKSTFSVEIVPVCKDNLVCLSPKLAQSLGNMNQICICVRVTSTIHLIDPSTLQIAEVDGNTYWRSPFNSLFHPKQLEEFIVMDTDIVRDRKQAAGAGMRSNKHILAEVWVQKTSEMNTTQQYHCRTHLGHLLNPGDLVLGFDLANCNLNDEFINKMNPHHIPDVVLIKKSYDRTKRQRRRNWKLKEIERDREGMDTDDERQYQDFLEDLEEDEVIRKNVNIYKNANLPVESDTDEEGAPRISLAEMLEDLHISLDATGGEGAEMLTE

SEQ ID NO: 2943 - protein, 197 aa, Xenopus tropicalis
GTWIQCALESRELLTLCLKKLKANLSKVRLIDAGFIWTEPHSKRLKVKLTIQKEVMNGAILQQVFVVDYIVQSQMCDDCHRVEAKDFWKAVVQVRQKVLHKKTFYYLEQTILKHRLHQNTLRVKEIHDGLDFYYASKQHAQKMVEFLQCTVPCRFKASQRLISHDIHTNAYNYKSTFSVEIVPVCKDNLVCLSPKLA

SEQ ID NO: 2944 - protein, 111 aa, Xenopus tropicalis
TWIQCALESRELLTLCLKKLKANLSKVRLIDAGFIWTEPHSKRLKVKLTIQKEVMNGAILQQVFVVDYIVQSQMCDDCHRVEAKDFWKAVVQVRQKVLHKKTFYYLEQTIL

SEQ ID NO: 2945 - protein, 335 aa, Xenopus tropicalis
MAARTRETGNTATVAETAVKQVQIDGMVVLKIIKHYQEEGHGSEVVQGVLLGLVVDDRLEITNCFPFPQHTEDDVDFDEVQYQMEMMRSLRHVNIDHLHVGWYQSTFYGTFVSRALLDSQFSYQHAIEESVVLIYDPIKTGQGSLSLKAYRLTPKLMEVCKEKDFSAEGLKKANIAFEDMFEEVPIIIKNSHLINVLAWELDKKAPVTEKHELLNLSSSNHLEKSLQLLMDRVDELSQDIVKYNTYLRNISKQQQQKHQYTQRRQQENLQRQSRGETSLPEEDVNKLFKPPVPPSRMDSLLIAGQINTYIQHIKEFTSQNLGKLFMAEAMQDPTI

SEQ ID NO: 2946 - protein, 86 aa, Xenopus tropicalis
MKQLIQEGYVGELQVCEVQVHSGSLLGKKYNWSCDDLMGGGGLHSVGSYIIDLLTFLTSQKAVKVHGLLKTFVKQTDHIKGIRQIT

SEQ ID NO: 2947 - protein, 195 aa, Xenopus tropicalis
VIIPLLKDEGFSVKALWGRTQEEAEELAKEMSVPFYTNRIDDVLLHQDVDLVCINLPPPLTKQIAVKTLGIGKNVICDRTATPLDAFRMMSAAHYYPKLMSIMGNVLRFLPAFVKMKQLIQEGYVGELQVCEVQVHSGSLLGKKYNWSCDDLMGGGGLHSVGSYIIDLLTFLTSQKAVKVHGLLKTFVKQTDHIK

SEQ ID NO: 2948 - protein, 1335 aa, Mus musculus
MSSSVRRKGKPGKGDGKGSSRGGRGGKGHMNKSHGGGGGGGGSCGGGGGGSRKASNRIWDDGDDFCVFTEPKRPSRRGTSGEEEDSEPQCGEEQGWPAGQEPIFLPDCSPWEYIGPEEVEPPVPECAVSPLAVQKLSRYGFHTEHCQLALRICDGDLGAALEHLLRQCFSETFGERMALSEAAVYVSLNECVEQRQEETLALKSICGEKFIERIQNRVWTIGLELDYLTNKFCKSKQKESSKNVRDTSPETCKFYLKGNCKFGSKCKFKHEVPPHQMIGRAERNVNDPHLDADDDTTFMYELQIRFSKDHKYPYQAPLVAFYSTNENLPLACRLHISEFLYGKALEFAKTSEPVVYSLITLLEEESEIVKLLTHTQHKYSVPPVNVPPVPSETRISKPAYRKPVVPSNTFLSNQMLEGERLSELEEDADEDEGPASIIVENESYVNLKKRSYKRYDRPAKSLFAENSKICRQFQMKQASRQFHAILQERQLLPAWEERETILKLLSKHQVVVISGMTGCGKTTQIPQFILDNSLNGPPERVANIICTQPRRISAISVAERVAKERAERVGLTVGYQIRLESVKSSATRLLYCTTGVLLRRLEGDATLQGVTHIIVDEVHERTEESDFLLLVLKDIVMQRATLQVILMSATLDAGLFSKYFSYCPVITIPGRAFPVDQFFLEDALAVTRYVLQDGSPYMRSMKQIAKEKLKARHNRTAQEEVEEDLRLSLHLQDEEESVKDTIPDQQLDFKQLLIRYKGVSKSVIKTMSVMDFEKVNLELIEALLEWIVDGKHAYPPGAVLVFLPGLAEIKMLYEQLQSNSLFNNRRSHRCVIHPLHSSLSSEEQQAVFVKPPMGVTKIIISTNIAETSITIDDVVYVIDSGKMKEKRYDAGKGMESLEDTFVSQANALQRKGRAGRVASGVCFHLFTSHHYNHQLLKQQLPEIQRVPLEQLCLRIKILEMFSTHNLQSVFSRLIEPPHIDSLRASKVRLRDLGALTPDEKLTPLGYHLASLPVDVRIGKLMLLGSIFRCLDPALTIAASLAFKSPFVSPWDKKEEANQKKLEFAFANSDYLALLCAYKGWQLSTKESARASYNYCRQNFLSGRTLQEMASLKRQFTELLSDIGFVKEGLRAKEIEKRAQGGDGVLDATGEEANTNAENPKLISAVLCAALYPNVVQVKTPEGKFQKTSSGVVRLQPKSAELKFVTKNDGYVHIHPSSVNYQVRHFDSPYLLYHEKIKTSRVFIRDCSMVSVYPLVLFGGGQVNVQLQRGAFVVSLDDGWIRFVAASHQVAELVKELRCELDQLLQDKIKNPSMDLCSCPRGSRIISMIVKLITTQ

SEQ ID NO: 2949 - protein, 74 aa, Mus musculus
TVQEHLIEKYMLLPNQVWDSIIQQATKNVDILKDPETVKQLGSILKTNVRACKAVGHPFVIQLGRIYLDMLNVY

SEQ ID NO: 2950 - protein, 79 aa, Mus musculus
TVQEHLIEKYMLLPNQVWDSIIQQATKNVDILKDPETVKQLGSILKTNVRACKAVGHPFVIQLGRIYLDMLNVYKCLSE

SEQ ID NO: 2951 - protein, 415 aa, Danio rerio
MLQNTGKLAGCTIFITGASRGIGKAIALKAAQDGANVVIAAKTADPHPKLPGTIYTAAAEIEAAGGKALPCIVDVRDEKQINDAVEQAVEKFGGIDILVNNASAINLTGTLQTPMKKADLMLGINLRGTYLTSKLCIPHLLKSKNPHILNLSPPLNLNPIWFKNHTAYTIAKYGMSMCVLGMAEEFRGSIAVNALWPKTAIQTAAMDMLGGSEVGKQCRKVEIMADAAYAIFKQPTSFTGQFVIDEDILKKEGIKDFDVYAVEPGHPLLPDFFLDGQPEDLVKHMEAHGATPAFTTAKADPVAAGPVSEMFNTIRGIISPEMVKTTQGVYKFNLAGEHAGVWYLDLKNDAGSAGNGEPPVKADVVMSMDSEDFVKMFGGKLKPTMAFMSGKLTIKGDMGLAIKLEKMMAMMKSKL

SEQ ID NO: 2952 - protein, 157 aa, Mus musculus
QPKAAGSSLLNKITNSLVLNVIKLAGVHSVASCFVVPMATGMSLTLCFLTLRHKRPKAKYIIWPRIDQKSCFKSMVTAGFEPVVIENVLEGDELRTDLKAVEAKIQELGPEHILCLHSTTACFAPRVPDRLEELAVICANYDIPHVVNNAYGLQSSK

SEQ ID NO: 2953 - protein, 45 aa, Mus musculus
LNVIKLAGVHSVASCFVVPMATGMSLTLCFLTLRHKRPKAKYIIW

SEQ ID NO: 2954 - protein, 457 aa, Xenopus tropicalis
MSAENGSPGLPNGGVCCATDSGRCSLVGNKVTVVLGAQWGDEGKGKVVDLLAQDADIVCRCQGGNNAGHTVVVDSVEYDFHLLPSGIINQNAIAFIGNGVVIHLPGLFEEAEKNLKKGQGLVGWEKRLCISDRAHIVFDFHQAADGIQEQQRQEQAGKNLGTTKKGIGPVYSSKAARSGLRMCDLVSDFSEFSQRFKLLAKQYKSMYPSLEIDIDGELKKLQDYADRVKPMVKDGVYYLYEALHGPPKNILVEGANAALLDIDFGTYPFVTSSNCTVGGVCTGLGIPPQSVGDVYGVVKAYTTRVGIGAFPTEQNNDTGEMLQTRGHEYGVTTGRKRRCGWLDLVLLRYAHMINGFTALALTKLDILDVLSEIKVGVSYKIDGKKIPHFPANQEVLNRVEVEYETLPGWNTDTCNVRTFEELPENAKKYVRYIELELGIPIKWIGVGKSRESMIQLF

SEQ ID NO: 2955 - protein, 55 aa, Mus musculus
ICHGLQLEATRSVSDDKLVFVKVHAPWEVLCTYAEIMHIKLPLKPNDLKTRSPFG

SEQ ID NO: 2956 - protein, 31 aa, Mus musculus
FVKVHAPWEVLCTYAEIMHIKLPLKPNDLKT

SEQ ID NO: 2957 - protein, 53 aa, Mus musculus
IGESAVEKLILKSGKTDQIFLTTQGFLTTAYHYVQCPVPVLKWLFRMMSVHTD

SEQ ID NO: 2958 - protein, 49 aa, Mus musculus
KLILKSGKTDQIFLTTQGFLTTAYHYVQCPVPVLKWLFRMMSVHTDCIV

SEQ ID NO: 2959 - protein, 1151 aa, Xenopus laevis
MSAPDYMQCAEDHQTLLVVVQPVGVIKNENFFKIYNRVSSVCQVNPMNTQRLLSIRYRHQYPVDNNEWGDFQTHRKVVGLICIAECTSARDLPHTILKFEQQKEAYSSTLYDSRLFLFGFQGEMADQSRIDVASYPSYDNCAAVDKRVEDFIQSLFIVLESKRLDRTSEKSGEKIPLLYVPYEKKDFVGLDPDSRHYKKRCQGRMRKHVGDLCLQAGMLQDALVHYHMAVELLRAVNDFVWLGAALEGLCSASVIHHYPGGTGGKAGTQLRQSVTMSADSFKRHRPGAQEVLIDPGALSTNGINMDASTEIGRAKNCLSPDDIIEKYKEAISYYGKSKAAGVIELEACVKAVRVLAIQKKSMDASEFLQNVVYINLRQLSEEEKIQRYSVLSELYELIGFHRKSAFFKRVAAMQCVAPSIVEPGWKACYKLLLETLPGYSLSLDPKDFSKGTHKGWAAVQMRLLHELVYASRRMGNPALAVRHLSFLLQTMLDFLSDQEKKDVAQSLESYTSKCPGTMDPITLPEGLVLPPVPFTKLPIVRSVKLLDLPVILRPQKVKNLLGQKLSTKSPFIYSPIIAHNRSEEKNKKIDFQWVQGDVCEVQLMVYNPMPFELRVETMGLLTSGVEFEYLPAALSLPAESGLYPVTLVGVPRTTGQITVNGYHTSVCGVYSDCLLDNLPGLKNNGCTVEVIPALPRLQISTSLPRSAHVLQPSSGDEVSTHVSVQLYNGETQKVIIKLENIGAEPLEKLEVTSKTVNTKEKFYGDFLSWDLEPTLSQFPLKPGNTATLTVYIKVKLDFSCQENLLQDLSDDGISVSGLQISSPFRHVSKPRVETKPVNQSDSKSSDFSHVKTLEGILNFKYSGGPGHVEGYYRNLSLGLHVDVEPSVFFTRVSTLPATSTRQCHLLFDVFNSTEHELTINAKDNQELILHAGECQRMAIQVDKFNFEGISDAPSEKQNYHNMKEIEEERQHSKGLEINSKLGIRWKIPTLKREGEASVEGVLNQLVLEHLQLAPLQWDVLVDGKPCDCDAIADCKVGDPIHLEVRLTNCSKNAVGPFALTVIPYQDYQNGVHNHELQDIVTFVGSNTFYIGAVQPMDRSVCFGALLFLYTGDFYLDIKFQDDNSNRELPLSWFCLPSVHIRAIDTLNETKF

SEQ ID NO: 2960 - protein, 334 aa, Xenopus laevis
MPEPVKVLVTGAAGQIAYSLLFGIAKGDVFGKDQPLILVLLDITPMMTVLEGVVMELQDCALPLLKEVIATDKEDVAFKDLDVAILVGSMPRREGMERKDLLKANVKIFKSQGAALNKYSKKSVKVIVVGNPANTNCLTALKSAPSIPKENFSCLTRLDHNRAKAQIALKLNVASDDVKNVIIWGNHSSTQYPDASHASVTLQGKDVGAFEAVKNDDWLKGGFITTVQQRGAAVIKARKLSSAMSAAKAICDHVRDIWFGTPEGQFVSMGVISDGNSYGVPEDLMYSFPLTIKNKTWKIVEGLCINDFSREKMDITAKELQDEKETAFEFLSSE

SEQ ID NO: 2961 - protein, 514 aa, Mus musculus
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKNLMESLDSLLCAEGSESLKSLCLKLLLCLVTVTDNISQNTILEYVMINSIFEAILQILSHPPSRREHGYDAVVLLALLVNYRKYESVNPYIVKLSIVDDEATLNGMGLVITQALSEYNRQYKDKEEEHQSGFFSALTNMVGSMFIADAHEKLSVQTNEAILLALYEAVHLNRNFITVLAQSHPEMGLVTAPASPTPTTPATPLGTTPPSSDVISSVELSLDADVQTSNLLITFLKYSSIVMQDTKDEHRLHSGKLCLIILTCIAEDQYANAFLHDDNMNFRVNLHRMPMRHRKKAADKNLPCRPLVCAVLDLMVEFIVTHMMKEFPMDLYLRCVQVVHKLLCYQKKCRVRLHYTWRELWSGIILKLSGSAASTYTF

SEQ ID NO: 2962 - protein, 81 aa, Danio rerio
TMIGIVWTSVMSSVEWNKKEELVTEQAIKHLKQYSPLLKAFTSQGLSELTLLLKIQEYCYDNIHFMKAFQKIVVLLYKADV

SEQ ID NO: 2963 - protein, 107 aa, Danio rerio
TMIGIVWTSVMSSVEWNKKEELVTEQAIKHLKQYSPLLKAFTSQGLSELTLLLKIQEYCYDNIHFMKAFQKIVVLLYKADVLSEEVILKWYTEGHVAKGKSVFLEQM

SEQ ID NO: 2964 - protein, 528 aa, Mus musculus
MIKKVLQLLIFHLTLAEIVLSGNVVVWPTDGSHWLNIKILLEELVQRNHSVTVLAPSETLFINSRLDAFINFEEIPVSYTKSKIDEIIEHMIALWLDHRPTPLTMWTFYKELGNLLATFYTTNKQMCDGVLNNPTVMERLQKGGFDVLLADPVTMCGELVALKLGIPFVYTLRFSPAFTVERHCGKIPAPISYVPAALSELTDQMSFGERVKNIISYSLQDYIFKTYWGEWNSYYSKVLGRPTTLCETMGKAEIWLMRTYWDFEFPRPYLPNFEFVGGLHCKPAKPLPKEMEEFVQTSGEHGIVVFSLGSMVKNLTDEKANLIASALAQIPQKVLWRYKGKIPDTLGSNTRLFDWIPQNDLLGHPKTRAFITHGGTNGIYEAIYHGIPMVGVPMFADQPDNIAHMKAKGAAVEVNMNTMTSSDLLNALRTVINEPSYKENAMRLSRIHHDQPVKPLDRAVFWIEFVMRHKGAKHLRVAAHDLSWFQYHSLDVIGFLLACVASAILLVAKCCLFIFQKVGKTGKKKKRD

SEQ ID NO: 2965 - protein, 51 aa, Mus musculus
EEALRNLSHTEVSKFVLDRIFVCDKHKILFCQTPKVGNTQWKKVLIVLNGM

SEQ ID NO: 2966 - protein, 32 aa, Mus musculus; identical to SEQ ID NO: 2646

SEQ ID NO: 2967 - protein, 83 aa, Rattus norvegicus
LKSRLKIAQPLHLPPRPDNDGFRAKMYDITQHPFFKRTIALLVLAQSVLLSVKWDVEDPVTVPLATMSVVFTFIFVLEVTMKI

SEQ ID NO: 2968 - protein, 77 aa, Rattus norvegicus
KHVTLKMLLLTVVVSMYKSFFIIVGMFLLLLCYAFAGVVLFGTVKYGENINRHANFSSAGKAITVLFRIVTGEDWNK

SEQ ID NO: 2969 - protein, 110 aa, Rattus norvegicus
LWVSSYCESVLRPYKLNIQKKKKKKKETSIVMPPIFTSFQDYVTGLQTVISNAVDHIKGLEAHLIALKLEELTLEDTSISPVNLSNCHVLSVRRRDPGSYWKLGAVEPMC

SEQ ID NO: 2970 - protein, 101 aa, Rattus norvegicus
YKLNIQKKKKKKKETSIVMPPIFTSFQDYVTGLQTVISNAVDHIKGLEAHLIALKLEELTLEDTSISPVNLSNCHVLSVRRRDPGSYWKLGAVEPMCADVC

SEQ ID NO: 2971 - protein, 129 aa, Mus musculus
WLDFSVITLAYVGAAIDLRGISGLRTFRVLRALKTVSVIPGLKVIVGALIHSVRKLADVTILTVFCLSVFALVGLQLFKGNLKNKCIKNGTDPHKADNLSSEMAGDIFIKPGTTDPLLCGNGSDAGHCP

SEQ ID NO: 2972 - protein, 125 aa, Mus musculus
VLRALKTVSVIPGLKVIVGALIHSVRKLADVTILTVFCLSVFALVGLQLFKGNLKNKCIKNGTDPHKADNLSSEMAGDIFIKPGTTDPLLCGNGSDAGHCPNDYVCRKTSDNPDFNYTSFDSFAW

SEQ ID NO: 2973 - protein, 129 aa, Mus musculus; identical to SEQ ID NO: 2971

SEQ ID NO: 2974 - protein, 125 aa, Mus musculus; identical to SEQ ID NO: 2972

SEQ ID NO: 2975 - protein, 292 aa, Mesocricetus auratus
MHFMKKYLLPILVLFLAYYYYSTKEEFRPEMLQGKKVIVTGASKGIGREMAYHLSEMGAHVVLTARSEEGLQKVASRCLELGAASAHYIAGTMEDMTFAEQFVLKAGKLMGGLDMLILNHITYTSMNFFRDEIHALRKAMEVNFISYVVMSVAALPMLKQSNGSIVVVSSIAGKMAHPLVASYSASKFALDGFFSSLRREHGVTNVNVSITLCVLGLINTETAMKATSGVFNAPASPKEECALEIIKGGALRQEEVYYDSWSWTPILLGNPGRKIMEFLSMKSFTFDKLISS

SEQ ID NO: 2976 - protein, 38 aa, Arabidopsis thaliana
DGIWTLPSSVLAIAGVKPPICMKFLSAATNHRVDKFLQ

SEQ ID NO: 2977 - protein, 34 aa, Arabidopsis thaliana
WTLPSSVLAIAGVKPPICMKFLSAATNHRVDKFL

SEQ ID NO: 2978 - protein, 122 aa, Arabidopsis thaliana
EEKESVHGYNALKYMLTIIAVIVRTAYELKKGRTWMILALVSSGVATGMNTFWDIVIDWGLLRKHSKNPYLRDKLLVPHKSVYFAAMVVNVILRVAWMQLVLEFNLKSLHKIAVTSIISCLE

SEQ ID NO: 2979 - protein, 103 aa, Arabidopsis thaliana
KYMLTIIAVIVRTAYELKKGRTWMILALVSSGVATGMNTFWDIVIDWGLLRKHSKNPYLRDKLLVPHKSVYFAAMVVNVILRVAWMQLVLEFNLKSLHKIAVT

SEQ ID NO: 2980 - protein, 417 aa, Sus scrofa
MSLSKKLTLDKLDVKGKRVIMRVDFNVPMKRNQVTNNQRIKASLPSIRYCLDNGARSVVLMSHLGRPDGVAMPDKYSLEPVAAELKSLLGKDVLFLKDCVGSEAEQACANPPAGSVILLENLRFHVEEEGKGQDPSGNKLKAEPDKVEAFRASLSKLGDVYVNDAFGTAHRAHSSMVGVNLPQKASGFLMKKELDYFAKALENPERPFLAILGGAKVADKIQLIKNMLDKVNEMIIGGGMAFTFLKVLNNMEIGASLFDKEGATIVKEIMAKAEKNRVNITFPVDFVIADKFEENAKVGQATVASGIPAGWVALDCGPETNKKYAQVVARAKLIVWNGPLGVFEWDAFANGTKALMDEIVKATSKGCITIIGGGDTATCCAKWNTEDKVSHVSTGGGASLELLEGKVLPGVEALSNL

SEQ ID NO: 2981 - protein, 237 aa, Rattus norvegicus
MAESSAATQSPSVSSSSSGAEPSTLGGGGGSPGACPALGAKSCGSSCAVHDLIFWRDVKKTGFVFGTTLIMLLSLAAFSVISVVSYLILALLSVTISFRVYKSVIQAVQKSEEGHPFKAYLDVDITLSSEAFHSYMNAAMVHVNKALKLIIRLFLVEDLVDSLKLAVFMWLMTYVGAVFNGITLLILAELLVFSVPIVYEKYKTQIDHYVGIARDQTKSIVEKIQAKLPGIAKKKAE

SEQ ID NO: 2982 - protein, 192 aa, Rattus norvegicus; identical to SEQ ID NO: 1529

SEQ ID NO: 2983 - protein, 44 aa, Caenorhabditis elegans
KKATKQMRREHKATVTLAVVLAVFLFCWLPFFVLHLSNSICLII

SEQ ID NO: 2984 - protein, 49 aa, Caenorhabditis elegans
KKATKQMRREHKATVTLAVVLAVFLFCWLPFFVLHLSNSICLIIDENSA

SEQ ID NO: 2985 - protein, 44 aa, Caenorhabditis elegans; identical to SEQ ID NO: 2983

SEQ ID NO: 2986 - protein, 49 aa, Caenorhabditis elegans; identical to SEQ ID NO: 2984

SEQ ID NO: 2987 - protein, 48 aa, Mus musculus
ASPSNHKVIPVYVGVNIKGLHLLNMETKALLISLKYCCFTWQLGDAGT

SEQ ID NO: 2988 - protein, 67 aa, Mus musculus
VIPVYVGVNIKGLHLLNMETKALLISLKYCCFTWQLGDAGTCFQIHSMENKMSFIVHTKQAGLVVKL

SEQ ID NO: 2989 - protein, 48 aa, Mus musculus; identical to SEQ ID NO: 2987

SEQ ID NO: 2990 - protein, 67 aa, Mus musculus; identical to SEQ ID NO: 2988

SEQ ID NO: 2991 - protein, 365 aa, Ammi majus
MNTTTELIPPTFQVNDDEEEACMFAMQLASASVLPMVLKSAIELNLLESIAKAGPGAYVSPSQLAAALPSSQPDTPVMLDRILRLLASYSVLNCKLRDLPDARVERLYGLAPVCKFLTKNSDGVSMAPLLLMNQDKILMESWYHLKDAVLDGGIPFNKAYGMTAFEYHGKDPRFNKVFNQGMSNHSTITMKKILQTYDGFGGLKTVVDVGGGTGATLNMIISKYPNLKGINFDLPHVVEDAPSYAGVEHVGGDMFVSVPKGDAIFMKWICHDWSDAHCLAFLKNCYKALPKDGKVILAECILPEAPDSKLTTKNVILIDVIMLAHNPGGKERTEKEFEAFGKQAGFKSFNKACCAYNTWVIEYYK

SEQ ID NO: 2992 - protein, 354 aa, Ammi majus
MAEMKTSPSQDEEAGVVAMQLATSTVLPMILKSAIELDLLNTIAKAGPGNYLSPSDLASKLLLSNPDAPVMLARILRVLATYKVLGCKRGEVEWLYCWTPVCKYLSNNEDGASIAPILLVHQDKVTIKSWYHLTDAVRDGGTAFNKAHDMSIFEYASQDPQFNKAFNRSMRGHSTITMKKILETYKGFEGLKSIVDVGGGTGATLNMIISKYPTIKGINFDLPHVVGDAPSLPGVEHVGGNMFASVPKGDAIFLKWIFHSWGDEECLKILKKCHQALGDNKKVIVAEFILPEDPGGSDSATKSAVHLDAIMLAYVPGGKERTEKEFESLAKRAGFKSFTKVCCAFNTWIMEFSK

SEQ ID NO: 2993 - protein, 288 aa, Dictyostelium discoideum
MDYIENQGAYGTPTASIDWCELNYTYSPYIAEFYNTFSSLIISLFGIYGIWIMMPNFGTGVEKEHIKILKQLDVRNKVILSYISLIVVGVGSAFYHATLLYQNQLFDELPMIYTALIMLYIMVTVGEEKTKKGFKGGVLGNSLLRHLLPYLLIAYGLFVTITILVIQDQPKILQVSFGALVFYVVFHSIYLINKKKPDGMPSNPDSYLYKYAFVSMLVGFTCWVVERYFCKNGKTFGFQLHAFWHFFTGMSTYVWTQFLICKLLEAKHYCVGIKHTLGLPRIHAIKRF

SEQ ID NO: 2994 - protein, 159 aa, Dictyostelium discoideum
LIMLYIMVTVGEEKTKKGFKGGVLGNSLLRHLLPYLLIAYGLFVTITILVIQDQPKILQVSFGALVFYVVFHSIYLINKKKPDGMPSNPDSYLYKYAFVSMLVGFTCWVVERYFCKNGKTFGFQLHAFWHFFTGMSTYVWTQFLICKLLEAKHYCVGIK

SEQ ID NO: 2995 - protein, 99 aa, Dictyostelium discoideum
WIMMPNFGTGVEKEHIKILKQLDVRNKVILSYISLIVVGVGSAFYHATLLYQNQLFDELPMIYTALIMLYIMVTVGEEKTKKGFKGGVLGNSLLRHLLP

SEQ ID NO: 2996 - protein, 125 aa, Rattus norvegicus; identical to SEQ ID NO: 2408

SEQ ID NO: 2997 - protein, 111 aa, Rattus norvegicus; identical to SEQ ID NO: 2409

SEQ ID NO: 2998 - protein, 125 aa, Rattus norvegicus; identical to SEQ ID NO: 2408

SEQ ID NO: 2999 - protein, 111 aa, Rattus norvegicus; identical to SEQ ID NO: 2409

SEQ ID NO: 3000 - protein, 125 aa, Rattus norvegicus; identical to SEQ ID NO: 2408

SEQ ID NO: 3001 - protein, 111 aa, Rattus norvegicus; identical to SEQ ID NO: 2409

SEQ ID NO: 3002 - protein, 33 aa, Bos taurus
KWNQEFTKHQVLIMTCYVALNVLKNGYLSLSDI

SEQ ID NO: 3003 - protein, 199 aa, Bos taurus
KYQVELLEAALDHNTIVCLNTGSGKTFIAVLLTKELSYQIRGDFNRNGKRTVFLVNSANQVAQQVSAVRTHSDLKVGEYSNLEVSASWTKEKWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLD

SEQ ID NO: 3004 - protein, 134 aa, Cyamopsis tetragonoloba
SCGPANLFKKMTKEIICCKRVPLLKRLHLIYAFFFVRKIVAHWVTFFFYCIVIPACVIVPEVNLKKQIAIYIPATITILNAVSTPRSMHLLVLWILFENVMSLHRTKAAIIGLLEANRVNEWVVTEKLGNAMKQ

SEQ ID NO: 3005 - protein, 108 aa, Cyamopsis tetragonoloba
LFKKMTKEIICCKRVPLLKRLHLIYAFFFVRKIVAHWVTFFFYCIVIPACVIVPEVNLKKQIAIYIPATITILNAVSTPRSMHLLVLWILFENVMSLHRTKAAIIGLL

SEQ ID NO: 3006 - protein, 82 aa, Mus musculus
ERSQILFHGVSVCVITLIVNRFILPMAVTKLGLRDVTSTKYKSVYYTFQHFQELTKSTAMALKFDKDLANADWNMVDNAIIL

SEQ ID NO: 3007 - protein, 77 aa, Mus musculus
LFHGVSVCVITLIVNRFILPMAVTKLGLRDVTSTKYKSVYYTFQHFQELTKSTAMALKFDKDLANADWNMVDNAIIL

SEQ ID NO: 3008 - protein, 98 aa, Canis familiaris
KALHDLMMFAGPEILKLLINFVNDKKAPDWQGYLYTALLFICACLQTLVLHQYFHICFVSGMRIKTAVIGAVYRKALVITNSARKSSTVGEIVNLMSV

SEQ ID NO: 3009 - protein, 74 aa, Canis familiaris
KLLINFVNDKKAPDWQGYLYTALLFICACLQTLVLHQYFHICFVSGMRIKTAVIGAVYRKALVITNSARKSSTV

SEQ ID NO: 3010 - protein, 45 aa, Vibrio anguillarum
QLVTVSKKHNVTPEITLASIFSTVLSLWGHQKYLMMRFDITKIND

SEQ ID NO: 3011 - protein, 32 aa, Vibrio anguillarum
VSKKHNVTPEITLASIFSTVLSLWGHQKYLMM

SEQ ID NO: 3012 - protein, 30 aa, Mus musculus
FTLQMKLTHVISMVQDWCALDEKVLIEAYK

SEQ ID NO: 3013 - protein, 85 aa, Mus musculus
VQDWCALDEKVLIEAYKKCLAVLTQCHGGFTDGEQPITLSICGHSVETIRYCVSQEKVSIHLPISRLLAGLHVLLSKSEVAYKFP

SEQ ID NO: 3014 - protein, 30 aa, Mus musculus; identical to SEQ ID NO: 3012

SEQ ID NO: 3015 - protein, 85 aa, Mus musculus; identical to SEQ ID NO: 3013

SEQ ID NO: 3016 - protein, 891 aa, Arabidopsis thaliana
MAPVPDPNSVGGGAKRDEATTKIPSKDSKKKDDKKEEDLSEEDLQLKQNLELYVERVQDPNPELQKIALESMRKEIRDSTSSMTSVPKPLKFLRPHYGVLKEFHAKMAESDLKKMLADILSVLALTMSAEGERESLNYRLNGSESDIGSWGHEYVRNLAGEIAKEYTIRQGEESSIEDLMDLVQQIVSFHMKHNAETEAVDLLMDVEDLDLLLEHVDNTNFRRTCNYLTSAAKYLPGPDDMLVLDIAYMIYIKFAEYPNALQIALFLDNMQYVKQVFTSCTDLVKKKQFCYMIARHGMTFELDQEMVANDEDKEALQDIVNNSKLSEGYLTLARDIEVMEAKTPEDIYKAHLLDGRASSGPSVDSARQNLSATFVNAFVNAGFGQDKLMTVPSDSTSGSAGNWLFKNKEHGKTSAVASLGMIQLWDVETGLGHLDKYFHSNDNPVVAGALLGVGIVNCGIKNDCDPAFALLSGYIDNEDSSVRIGAIMGLGIAYAGSQNDQIKIRLSPILNDANAPLDVIAFAALSLGMIYVGSCNEEVAQSIIFALMDRSEAELGEALTRFLPLGLGLLYLGKQESVEATAEVSKTFNEKIRKYCDMTLLSCAYAGTGNVLKVQDLLAQCGEHLVKGDIHQGPAVIGLAMVAMSEELGLDMEIRSLERVLQYGEQNIRRAVPLALGLLCISNPKVTVMDTLSRLSHDTDSEVAMAAIISLGLIGAGTNNARIAGMLRNLSSYYYKDASLLFCVRIAQGFVHMGKGLLTLNPFHSERLLLSPTALAGIVTLLHACLDMKSIILGKYHYVLYFLVLAMQPRMMLTVDQSLKPISVPVRVGQAVDVVGQAGRPKTITGFQTHSTPVLLAAGERAELATEKYIPLSPILEGFVILKENPDYREE

SEQ ID NO: 3017 - protein, 177 aa, Oryza sativa
CLGVPTVDMQNVCHQLEDKTGGLIIHRHGGQLILYRGRHYNPKKRPVIPLMLWKPAEPVYPRLIKTTIEGLTVEETKEMRKKGLYVPVLTKLAKNGYYASLVPMVRDAFLTDELVRIDSKGLPKSDYRKIGVKLRDLVPCIIVSFDKEQIIVWRGKDYNGTIQDNTQKTSVSVLEEE

SEQ ID NO: 3018 - protein, 114 aa, Oryza sativa
VPTVDMQNVCHQLEDKTGGLIIHRHGGQLILYRGRHYNPKKRPVIPLMLWKPAEPVYPRLIKTTIEGLTVEETKEMRKKGLYVPVLTKLAKNGYYASLVPMVRDAFLTDELVRI

SEQ ID NO: 3019 - protein, 361 aa, Oryza sativa
MKALILVGGFGTRLRPLTLSFPKPLVDFANKPMILHQIEALKEVGVTEVVLAINYRPEVMLNFLKDFEDKLGITITCSQETEPLGTAGPLALARDKLVDGSGEPFFVLNSDVISEYPFAELIKFHKNHGGEATIMVTKVDEPSKYGVVVMEEATGMVEKFVEKPKIFVGNKINAGIYLLNPSVLDRIELKPTSIEKEVFPRISADAKLFAMVLPGFWMDVGQPRDYITGLRLYLDSLRKRSANRLATGAHIVGNVLVHESAKIGEGCLIGPDVAIGPGCVVEDGVRLSRCTVMRGVRIKKHACISNSIIGWHSTVGQWARIENMTILGEDVHVGDEVYTNGGVILPHKEIKSSILKPEIVM

SEQ ID NO: 3020 - protein, 136 aa, Danio rerio
SVFAAKAPADLDLDPDTWDNKTITSGLKNYLRCLAEPLMTYRLHKDFIMAVKSDDQNYRVCAVHALVYKLPDKNKEMLNLLIKHLHVVSTHSQKNLMTVSNLGVIFGPTLMRSQEETVAAMMNIKFQNIVVEILIE

SEQ ID NO: 3021 - protein, 118 aa, Danio rerio
WDNKTITSGLKNYLRCLAEPLMTYRLHKDFIMAVKSDDQNYRVCAVHALVYKLPDKNKEMLNLLIKHLHVVSTHSQKNLMTVSNLGVIFGPTLMRSQEETVAAMMNIKFQNIVVEILI

SEQ ID NO: 3022 - protein, 154 aa, Mus musculus
FGLNMFHQLGIIPPPASCNVPRQIQAKYLKGRTIIGVAAGRFHTVLWTREAVYTLGLNGGQLGHLLDPNGEKCVTTPRQVSALHHKDIAVSLVAASDGATVCVTTRGDIYLLADYQCKKMATKQLNLKKVLVSGGCMEYKVDPEHLTENGGQKI

SEQ ID NO: 3023 - protein, 115 aa, Mus musculus
IEKGVDLLVKDKESGWTALHRSVFYGHIDCVWSLLKHGVSLYMQDKEGLSPLDLLMKDRPTHVVFKDHTVVLTDDGCVYTFGLNMFHQLGIIPPPASCNVPRQIQAKYLKGRTII

SEQ ID NO: 3024 - protein, 146 aa, Mus musculus
DGITGLYFLSGAVHDRLLNVWQVRSENKEKSAVMSFTVTDEPVYVDLTLSENKEEPVKLAVVCRDGQVHLFEHILNGHCKKPLTSNCTIQIATPGKGKKVTPKPIPILAASFCLDKMSLLLVYGNWFQPTIERVALNSKDTHICLE

SEQ ID NO: 3025 - protein, 89 aa, Mus musculus
VYVDLTLSENKEEPVKLAVVCRDGQVHLFEHILNGHCKKPLTSNCTIQIATPGKGKKVTPKPIPILAASFCLDKMSLLLVYGNWFQPTI

SEQ ID NO: 3026 - protein, 359 aa, Bos taurus
MRSIRKRWTICTISLLLIFYKTKEMARTEEHQETQLIGDGELSLSRSLVNSSDKIIRKAGSSIFQHSVEGGKINSSLVLEIRKNILRFLDAERDVSVVKSSFKPGDVIHYVLDRRRTLNISQDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCIKQ

SEQ ID NO: 3027 - protein, 84 aa, Bos taurus; identical to SEQ ID NO: 1515

SEQ ID NO: 3028 - protein, 79 aa, Bos taurus; identical to SEQ ID NO: 1516

SEQ ID NO: 3029 - protein, 484 aa, Arabidopsis thaliana
MAAKKVFGSAEASNLVTELRRSFDDGVTRGYEWRVTQLKKLMIICDNHEPEIVAALRDDLGKPELESSVYEVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKIGRVIMAAAAKHLTPVVLELGGKSPVVVDSDTDLKVTVRRIIVGKWGCNNGQACVSPDYILTTKEYAPKLIDAMKLELEKFYGKNPIESKDMSRIVNSNHFDRLSKLLDEKEVSDKIVYGGEKDRENLKIAPTILLDVPLDSLIMSEEIFGPLLPILTLNNLEESFDVIRSRPKPLAAYLFTHNKKLKERFAATVSAGGIVVNDIAVHLALHTLPFGGVGESGMGAYHGKFSFDAFSHKKAVLYRSLFGDSAVRYPPYSRGKLRLLKALVDSNIFDLFKVLLGLA

SEQ ID NO: 3030 - protein, 257 aa, Viridovipera stejnegeri
MVLIRVLANLLILQLSYAQKSSELVVGGLPCNINEHRFLVLVYSDGIQCGGTLINKEWMLTAAHCDGKKMKLQFGLHSKNVPNKDKQTRVPKKKYFFPCSKNFTKWDKDIMLIRLNHPVNNSTHIAPLSLPSKPPSQDTVCNIMGWGTISPTKEIYPDVPHCAYINIVDHAVCRAFYPGLLEKSKTLCAGILEGGKDTCQGDSGGPLICNGQIQGIVSVGGDPCAEPRVSVLYTKVFDHLDWIKSIIAGNTAATCPL

SEQ ID NO: 3031 - protein, 257 aa, Viridovipera stejnegeri
MVLIRVLANLLILQLSYAQKSSELVVGGDECNINEHRFLVLVYTDGIQCGGTLINKEWMLTAAHCDGKKMKLQFGLHSKNVPNKDKQTRVPKKKYFFPCSKNFTKWDKDIMLIRLNHPVNNSTHIAPLSLPSKPPSQDTVCNIMGWGTISPTKEIYPDVPHCANINIVDHAVCRAFYPGLLEKSKTLCAGILEGGKDTCQGVSGGPLICNGQIQGIVSVGGDPCAEPRVPALYTKVFDHLDWIKSIIAGNTAATCPL

SEQ ID NO: 3032 - protein, 580 aa, Listeria monocytogenes
MTNHEQVLTDYLAAFIEELVQAGVKEAIISPGSRSTPLALMMAEHPILKIYVDVDERSAGFFALGLAKASKRPVVLLCTSGTAAANYFPAVAEANLSQIPLIVLTADRPHELRNVGAPQAMDQLHLYGSHVKDFTDMALPENSEEMLRYAKWHGSRAVDIAMKTPRGPVHLNFPLREPLVPILEPSPFTATGKKHHHVHIYYTHEVLDDSSIQKMVTECTGKKGVFVVGPIDKKELEQPMVDLAKKLGWPILADPLSGLRSYGALDEVVIDQYDAFLKEAEIIDKLTPEVVIRFGSMPVSKPLKNWLEQLSDIRFYVVDPGAAWKDPIKAVTDMIHCDERFLLDIMQQNMPDDAKDAAWLNGWTSYNKVAREIVLAEMANTTILEEGKIVAELRRLLPDKAGLFIGNSMPIRDVDTYFSQIDKKIKMLANRGANGIDGVVSSALGASVVFQPMFLLIGDLSFYHDMNGLLMAKKYKMNLTIVIVNNDGGGIFSFLPQANEPKYFESLFGTSTELDFRFAAAFYDADYHEAKSVDELEEAIDKASYHKGLDIIEVKTNRHENKANHQALWVKIADALKALD

SEQ ID NO: 3033 - protein, 922 aa, Rattus norvegicus
MFLHSVNLWNLAFYVFMVFLATLGLWDVFFGFEENKCSMSYMFEYPEYQKIELPKKLTKRYPAYELYLYGEGSYAEEHKILPLTGIPVLFLPGNAGSYKQVRSIGSIALRKAEDIDFKYHFDFFSVNFNEELVALYGGSLQKQTKFVHECIKAILKLYKGQEFPPTSVAIIGHSMGGLVARALLTLKNFKQDLINLLVTQATPHVAPVMPLDRFITEFYMTVNNYWILNARHINLTTLSVAGGFRDYQVRSGLTFLPTLSHHTSALSVVTSAVPKTWVSTDHLSIVWCKQLQLTTIRAFFDLIDADTKQITQKSKKKLSVLNHHFIRHPAKQFEENPSIISDLTGTSMWVPVKVSRWSYVAYNESDKIYFAFPLANHRKVYTHAYCQSTMLDTNSWIFGCINSTSMCRQGVDLSWKAELLPTIKSLTLRLQDYPSLSHIVVYVPSVHGSKFVVDCEFFKKEARSIQLPVTHLFSFGLSSRKAIINTSGRYYNIELLNLGQIYQAFKVNVVSKCTGGKEEITSIYKLHIPWSYEDSLTIAQVPSSVDISLKLHVAQPENDSHVALLKMYTSSDCQYEVTIKTSFPQILGQVVRFHGGALPAYVVSSILLAYGGQLYSLLSTGFCLEYGTMLDKEAKPYKVDPFVIMIKFLLGYKWFKELWDAVLLPELDAIVLTSQSMCFPLVSLILFLFGTCTAYWSGLLSSASVQLLSSLWLALKRPAELPKDVKVMSPDLPVLTVVFLIISWTTCGALAILLSYLYYVFKVVHLQASLTTFKNNQPVNPKHSRRSEKKSNHHKDSAIQNPRLSANDAEDSLRMHSTVINLLTWVVLLSMPSLIYWSKNLRYYFKLNPDPCKPLAFLLIPAIAVLGNTHTVSIKSSKLLKTASQFPLPLAVGVIAFGSSHLYRVPCFVIIPLVFHSLCNFM

SEQ ID NO: 3034 - protein, 98 aa, Rattus norvegicus
EELVALYGGSLQKQTKFVHECIKAILKLYKGQEFPPTSVAIIGHSMGGLVARALLTLKNFKQDLINLLVTQATPHVAPVMPLDRFITEFYMTVNNYWI

SEQ ID NO: 3035 - protein, 148 aa, Rattus norvegicus
VVSKCTGGKEEITSIYKLHIPWSYEDSLTIAQVPSSVDISLKLHVAQPENDSHVALLKMYTSSDCQYEVTIKTSFPQILGQVVRFHGGALPAYVVSSILLAYGGQLYSLLSTGFCLEYGTMLDKEAKPYKVDPFVIMIKFLLGYKWFK

SEQ ID NO: 3036 - protein, 333 aa, Rattus norvegicus
MCAQYCISFADVEKAHLNIQDSVHLTPVLTSSILNQIAGRNLFFKCELFQKTGSFKIRGALNAIRGLIPDTLEGKPKAVVTHSSGNHGQALTYAAKLEGIPAYIVVPQTAPNCKKLAIQAYGASIVYSEPSDESRENVAQRIIQETEGILVHPNQEPAVIAGQGTIALEVLNQVPLVDALVVPVGGGGMVAGIAITIKTLKPSVKVYAAEPSNADDCYQSKLKGELTPNLHPPETIADGVKSSIGLNTWPIIRDLVDDVFTVTEDEIKYATQLVWERMKLLIEPTAGVGLAAVLSQHFQTVSPEVKNICIVLSGGNVDLTSLSWVKQAERPAP

SEQ ID NO: 3037 - protein, 147 aa, Thunnus obesus; identical to SEQ ID NO: 1584

SEQ ID NO: 3038 - protein, 438 aa, Penicillium chrysogenum
MPISKIHARSVYDSRGNPTVEVDVVTETGLHRAIVPSGASTGLHEVVELRDGDKTKWGGKGVLNAVKNVNDVIGPALIKENIDVKDQAKVDEFLNKLDGTPNKGKLGANAILGVSLAVAKAAAAEKGVPLYAHISDLAGTKKPFVLPVPFQNVLNGGSHAGGRLAFQEFMIVPDTAPTFSEGLRQGAEVYQELKALAKKKYGQSAGNVGDEGGVAPDIQTAEEALDLITEAIEQAGYTGQIKIAMDVASSEFYKEDAKKYDLDFKNPESDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADIAVGLRAGQIKTGAPARSERLAKLNQILRIEEELGANAVYAGEKFRTAVNL

SEQ ID NO: 3039 - protein, 162 aa, Mus musculus; identical to SEQ ID NO: 1467

SEQ ID NO: 3040 - protein, 168 aa, Mus musculus; identical to SEQ ID NO: 1468

SEQ ID NO: 3041 - protein, 99 aa, Drosophila melanogaster
TSAILVPHRPEVGPSASLSGVVASLIALLVWMHWKYLHKPHIALFKLLLLCSVLVGIGTLPYQLNFLGLLAGVICGCLLTMSLVPFTTFSKYGRKKKIN

SEQ ID NO: 3042 - protein, 77 aa, Drosophila melanogaster
KYLHKPHIALFKLLLLCSVLVGIGTLPYQLNFLGLLAGVICGCLLTMSLVPFTTFSKYGRKKKINLIWTCVLFHVVV

SEQ ID NO: 3043 - protein, 241 aa, Staphylococcus aureus; identical to SEQ ID NO: 2540

SEQ ID NO: 3044 - protein, 802 aa, Staphylococcus aureus
MANTKKTTLDITGMTCAACSNRIEKKLNKLDDVNAQVNLTTEKATVEYNPDQHDVQEFINTIQHLGYGVTVETVELDITGMTCAACSSRIEKVLNKMNGVQNATVNLTTEQAKVDYYPEETDADKLVTRIQKLGYDASIKDNNKDQTSRKAEALQHKLIKLIISAVLSLPLLMLMFVHLFNMHIPALFTNPWFQFILATPVQFIIGWQFYVGAYKNLRNGGANMDVLVAVGTSAAYFYSIYEMVRWLNGSTTQPHLYFETSAVLLTLILFGKYLEARAKSQTTNALGELLSLQAKEARILKDGNEVMIPLNEVHVGDTLIVKPGEKIPVDGKIIKGMTAIDESMLTGESIPVEKNVDDTVIGSTMNKNGTITMTATKVGGDTALANIIKVVEEAQSSKAPIQRLADIISGYFVPIVVGIALLIFIVWITLVTPGTFEPALVASISVLVIACPCALGLATPTSIMVGTGRAAENGILFKGGEFVERTHQIDTIVLDKTGTITNGRPVVTDYHGDNQTLQLLATAEKDSEHPLAEAIVNYAKEKQLTLTETTTFKAVPGHGIEATIDHHHILVGNRKLMADNDISLPKHISDDLTHYERDGKTAMLIAVNYSLTGIIAVADTVKDHAKDAIKQLHDMGIEVAMLTGDNKNTAQAIAKQVGIDTVIADILPEEKAAQIAKLQQQGKKVAMVGDGVNDAPALVKADIGIAIGTGTEVAIEAADITILGGDLMLIPKAIYASKATIRNIRQNLFWAFGYNIAGIPIAALGLLAPWVAGAAMALSSVSVVTNALRLKKMRLEPRRKDA

SEQ ID NO: 3045 - protein, 688 aa, Staphylococcus aureus
MFKKLFGQLQRIGKALMLPVAILPAAGILLAFGNAMHNEQLVEIAPWLKNDIIVMISSVMEAAGQVVFDNLPLLFAVGTALGLAGGDGVAALAALVGYLIMNATMGKVLHITIDDIFSYAKGAKELSQAAKEPAHALVLGIPTLQTGVFGGIIMGALAAWCYNKFYNITLPPFLGFFAGKRFVPIVTSVVAIATGVLLSFAWPPIQDGLNSLSNFLLNKNLTLTTFIFGIIERSLIPFGLHHIFYSPFWFEFGSYTNHAGELVRGDQRIWMAQLKDGVPFTAGAFTTGKYPFMMFGLPAAAFAIYKNARPERKKVVGGLMLSAGLTAFLTGITEPLEFSFLFVAPVLYGIHVLLAGTSFLVMHLLGVKIGMTFSGGFIDYILYGLLNWDRSHALLVIPVGIVYAIVYYFLFDFAIRKFKLKTPGREDEETEIRNSSVAKLPFDVLDAMGGKENIKHLDACITRLRVEVVDKSKVDVAGIKALGASGVLEVGNNMQAIFGPKSDQIKHDMAKIMSGEITKPSETTVTEEMSDEPVHVEALGTTDIYAPGVGQIIPLSEVPDQVFAGKMMGDGIGFIPEKGEIVAPFDGTVKTIFPTKHAIGLESESGVEVLIHIGIDTVKLNGEGFESLINVDEKVTQAQPLMKVNLAYLKAHAPSIVTPMIITNLENKELVIEDVQDADPGKLIMTVK

SEQ ID NO: 3046 - protein, 241 aa, Staphylococcus aureus; identical to SEQ ID NO: 2540

SEQ ID NO: 3047 - protein, 308 aa, Staphylococcus aureus
MSKTAIIFPGQGAQKVGMAQDLFNNNDQATEILTSAAKTLDFDILETMFTDEEGKLGETENTQPALLTHSSALLAALKNLNPDFTMGHSLGEYSSLVAADVLSFEDAVKIVRKRGQLMAQAFPTGVGSMAAVLGLDFDKVDEICKSLSSDDKIIEPANINCPGQIVVSGHKALIDELVEKGKSLGAKRVMPLAVSGPFHSSLMKVIEEDFSSYINQFEWRDAKFPVVQNVNAQGETDKEVIKSNMVKQLYSPVQFINSTEWLIDQGVDHFIEIGPGKVLSGLIKKINRDVKLTSIQTLEDVKGWNEND

SEQ ID NO: 3048 - protein, 228 aa, Staphylococcus aureus; identical to SEQ ID NO: 2116

SEQ ID NO: 3049 - protein, 192 aa, Staphylococcus aureus
MELLGQKVKEDGVVIDEKILKVDGFLNHQIDAKLMNEVGRTFYEQFKDKGITKILTIEASGIAPAIMAALHFDVPCLFAKKAKPSTLTDGYYETSIHSFTKNKTSTVIVSKEFLSEEDTVLIIDDFLANGDASLGLYDIAQQANAKTAGIGIVVEKSFQNGHQRLEEAGLTVSSLCKVASLEGNKVTLVGEE

SEQ ID NO: 3050 - protein, 681 aa, Staphylococcus aureus
MRKKLFGQLQRIGKALMLPVAILPAAGLLLAIGTAIQGEALQHYLPFIQNGGVQNVAKLMTAAGSIIFENLPMIFALGVAIGLAGGDGVAAIAAFVGYIIMNKTMGDFLQVTPKNVTDPASGYASILGIPTLQTGVFGGIIIGALAAWCYNKFYNINLPSYLGFFAGKRFVPIMMATTSFILAFPMALIWPTIQSGLNAFSTGLLDSNTGVAVFLFGFIKRLLIPFGLHHIFHAPFWFEFGSWKNAAGEIIHGDQRIFIEQIREGAHLTAGKFMQGEFPVMMFGLPAAALAIYHTAKPENKKVVAGLMGSAALTSFLTGITEPLEFSFLFVAPLLFFIHAVLDGLSFLTLYLLDVHLGYTFSGGFIDYVLLGVLPNKTQWWLVIPVGLVYAVIYYFVFRFLIVKLKYKTPGREDKQSQAVTASATELPYAVLEAMGGKANIKHLDACITRLRVEVNDKSKVDVPGLKDLGASGVLEVGNNMQAIFGPKSDQIKHEMQQIMNGQVVENPTTMEDDKDETVVVAEDKSATSELSHIVHAPLTGEVTPLSEVPDQVFSEKMMGDGIAIKPSQGEVRAPFNGKIQMIFPTKHAIGLVSDSGLELLIHIGLDTVKLNGEGFTLHVEEGQEVKQGDLLINFDLDYIRNHAKSDITPIIVTQGNITNLDFKQGEHGNISFGDQLFEAK

SEQ ID NO: 3051 - protein, 167 aa, Yersinia pestis
MSTAKLVKTKPSELLYTRNDVEEHVKVATIKRLNQMVIQFIDLSLITKQAHWNMRGANFVAVHEMLDGFRTALTDHLDTFAERAVQLGGVALGTAQVINDKTPLKSYPTNIHSVQEHLKALAERYAIVANDIRKAITEVEDENSADMFTAASRDLDKFLWFIESNIE

SEQ ID NO: 3052 - protein, 148 aa, Brucella melitensis; identical to SEQ ID NO: 72

SEQ ID NO: 3053 - protein, 123 aa, Brucella melitensis; identical to SEQ ID NO: 73

SEQ ID NO: 3054 - protein, 1332 aa, Arabidopsis thaliana
MDLEFAVNGERFKIDSVDPSTTLLEFLRLNTPFKSVKLGCGEGGCGACLVVLSKYDPELDQVKECCINSCLTLLCSVNGCSITTSEGLGNTKKGFHPIHKRFAGFHASQCGFCTPGMCISLYSSLANAENNSSKDFTVSEAEKSVSGNLCRCTGYRPIVDACKSFASDVDIEDLGLNSFWKKGESKEVMFKNLPPYNPKDHLVTFPEFLKKKEKVDNGSDHLKYRWTTPFSVAELHNIMEAANSGDSLKLVVGNTGTGYYKDEERFDRYIDISNIPEMSMIKKDEKGIEIGAAVTISNAIDALEKESKSSYVFKKMATHMEKIGNRSIRNSGSIGGNLVMAQSRKFPSDVTTLLLAVDASVYMLNGRKTEKVTLQEFLELSPVLDSKRVLLKVEIPSWTAPSGDDTEFLFESYRAAPRSIGNALPYLNAAFLALVSRQEASRKGVTVEKCFLAFGSYGGDHSIRAIEVETFLTGKLLSYSVLYEAVGLLKGIIVPGKDTLHSEYRKSLAVGYLFEFFYPLIESGHRICSLDSGNKHNNSHVDTVKSLPFLSSSQQVLESNEFKPIGEAVIKVGAALQASGEAVFVDDIPTLPDCLHGAFIYSTEPLAKIKSLSFRENVTPTGVFAVLTFKDIPQQGQNIGSKTLFGPGPLFADELTRCAGQRIALVVADTQKHADMAAKLAVVEYDTKNLEQPILTVEDAVKRSSFFEVHPMFYPEPVGDVIKGMEEAERKIISSELRLGSQYFFYMEPQTALALPDEDNCVKVFSSSQAPEYVHSVIATCLGIQEHNVRVITRRVGGGFGGKAVKSMPVATACALGAYKLQRPVKMFLNRKTDMIMAGGRHPMKINYNVGFRSDGKLTALELTMLIDAGLEPDVSPIMPRNIMGPLRKYDWGALSFDVKVCKTNCLSRTAMRAPGEVQGSYIAESIIENVASSLQMDVDAVRKINLHTYDSLRKFYNHIAGDPDEYTLPLLWEKLEISSKFKERSEMVKEFNLCNVWRKRGISRVPIVHQVMQRPTPGKVSILSDGSVVVEVGGIEIGQGLWTKVQQMVAYGLGMVKCEGNEKLLDRIRVVQSDTLGMIQGGFTAGSTTSESSCEAVRLCCVILVERLKPIMDQMMMEKSGSVTWNILIQQAYGQYINLSASTLYKPEYSSMEYLNYGVGVSEVEVDLVTGKTEILRSDIIYDCGKSLNPAVDLGQTEGAFVQGIGFFMMEEYTTDEKGLVVQQGTWDYKIPTVDTIPKHFNVEIVNTGHHKNRVLSSKASGEPPLLLAASVHCATRSAIREARKHSLSSNFIDGSDSEFELPVPATMPVVKSLCGLYSVEKYLQGKIKGQ

SEQ ID NO: 3055 - protein, 147 aa, Cebus kaapori; identical to SEQ ID NO: 2099

SEQ ID NO: 3056 - protein, 387 aa, Drosophila melanogaster
MTSHPVFIDLSLDEQVQELRKYFKKLGAEISSEKSNKGVEDDLHKIIGVCDVCFKDGEPSQIDGILNSIVSIMITIPLDRGENIVLAYCEKMTKAPNLPLGKVCLQSLWRLFNNLDTASPLRYHVYYHLVQVAKQCEQVLEVFSGVDQLKSQFANCPPSSEQMQKLYRLLHDVTKDTNLELSSKVMIELLGTYTADNACVAREDAMKCIVTALADPNTFLLDPLLSLKPVRFLEGDLIHDLLSIFVSEKLPAYVQFYEDHREFVNSQGLNHEQNMKKMRLLTFMQLAESSPEMTFETLTKELQINEDEVEPFVIEVLKTKLVRARLDQANQKVHISSTMHRTFGAPQWEQLRDLLQAWKENLSTVREGLTSVSSAQLDLARSQKLIH

SEQ ID NO: 3057 - protein, 1024 aa, Drosophila melanogaster
MLARAIRVRPMMRGIASSSVWNRNRPIQSSLMQYCRDRSLRLQRLHGANLMVQRFYSRKRDDSNGDIIMGPDLMSDQDTHLPATVAVPDVWPHVPLLAMRKNPLFPRFMKIVEVSNPIIMDLLRRKVKLNQPYVGVFLKKTDGEEELITNLNDVYNLGTFAQIQELQDLGDKLRMVVVAHRRIRITGQVVEDVPPPKPVKMTTLHYPLFNIKLQIPAEDQSTDQADAAPIKSRSDPARKPRGRIPRSRTGKSRESAAAEELIQNQTLEPPLKSGKVESSSLPKPPTEEKIVEPETGAKENVNQSAPSAQPVLIVEVENVKQPIYKQTEEVKALTQEIIKTLRDIITMNPLYRESLQQMLHQNQRVVDNPIYLCDLGASLSAGEPAELQKILEETDIPERLQLALTLLKKELELSRLQQKIGREVEEKVKQQHRKYILQEQLKVIKKELGIEKDDKDAIGEKYREKLKDKVVPEAIMTVIDEELTKLNFLESHSSEFNVTRNYLDWLTSLPWGVISTENLCLEKATETLNDDHYGMEDIKKRILEFIAVSSLKGSTQGKILCFHGPPGVGKTSIAKSIARALNREYFRFSVGGMTDVAEIKGHRRTYVGAMPGKLIQCLKKTKIENPLVLIDEVDKIGKGYQGDPSSALLELLDPEQNANFLDHYLDVPVDLSRVLFICTANVIDTIPEPLRDRMELIEMSGYVAEEKIAIARQYLMPQAMKDCGLTDKHINISEDALNMLIRSYCRESGVRNLQKHIEKVIRKVAFRVVKKEGEHFPVNADNLTTFLGKQIFSSDRMYATTPVGVVMGLAWTAMGGSSLYIETSRRHIRQGAKTDPNTVAGSLHITGNLGDVMKESAQIALTVARNFLYSLEPNNLFLEQEHIHLHVPEGATPKDGPSAGITIITALVSLATGKPVRQDIAMTGEVSLKGKVLPVGGIKEKTIAARRSGVNCLILPVDNKKDFEELPTYITDGLEVHFATTYEDVYKIAFTDVTETTTNNVEEQEPLQKLSSAAAAKSETWPYS

SEQ ID NO: 3058 - protein, 1006 aa, Drosophila melanogaster
MLARAIRVRPMMRGIASSSVWNRNRPIQSSLMQYCRDRSLRLQRLHGANLMVQRFYSRKRDDSNGDIIMGPDLMSDQDTHLPATVAVPDVWPHVPLLAMRKNPLFPRFMKIVEVSNPIIMDLLRRKVKLNQPYVGVFLKKTDGEEELITNLNDVYNLGTFAQIQELQDLGDKLRMVVVAHRRIRITGQVVEDVPPPKPAEDQSTDQADAAPIKSRSDPARKPRGRIPRSRTGKSRESAAAEELIQNQTLEPPLKSGKVESSSLPKPPTEEKIVEPETGAKENVNQSAPSAQPVLIVEVENVKQPIYKQTEEVKALTQEIIKTLRDIITMNPLYRESLQQMLHQNQRVVDNPIYLCDLGASLSAGEPAELQKILEETDIPERLQLALTLLKKELELSRLQQKIGREVEEKVKQQHRKYILQEQLKVIKKELGIEKDDKDAIGEKYREKLKDKVVPEAIMTVIDEELTKLNFLESHSSEFNVTRNYLDWLTSLPWGVISTENLCLEKATETLNDDHYGMEDIKKRILEFIAVSSLKGSTQGKILCFHGPPGVGKTSIAKSIARALNREYFRFSVGGMTDVAEIKGHRRTYVGAMPGKLIQCLKKTKIENPLVLIDEVDKIGKGYQGDPSSALLELLDPEQNANFLDHYLDVPVDLSRVLFICTANVIDTIPEPLRDRMELIEMSGYVAEEKIAIARQYLMPQAMKDCGLTDKHINISEDALNMLIRSYCRESGVRNLQKHIEKVIRKVAFRVVKKEGEHFPVNADNLTTFLGKQIFSSDRMYATTPVGVVMGLAWTAMGGSSLYIETSRRHIRQGAKTDPNTVAGSLHITGNLGDVMKESAQIALTVARNFLYSLEPNNLFLEQEHIHLHVPEGATPKDGPSAGITIITALVSLATGKPVRQDIAMTGEVSLKGKVLPVGGIKEKTIAARRSGVNCLILPVDNKKDFEELPTYITDGLEVHFATTYEDVYKIAFTDVTETTTNNVEEQEPLQKLSSAAAAKSETWPYS

SEQ ID NO: 3059 - protein, 146 aa, Streptopelia orientalis
VHWSAEEKQLITSIWGKVNVADCGAEALARLLIVYPWTQRFFASFGNLSSATAISGNPNVKAHGKKVLTSFGDAVKNLDNIKGTFAQLSELHCNKLHVDPENFKLLGDILVIVLAAHFGKDFTPECQAAWQKLVRVVAHALARKYH

SEQ ID NO: 3060 - protein, 292 aa, Oryctolagus cuniculus
MAFMKKYLLPLLGLFLAYYYYSANEEFRPEMLQGKKVIVTGASKGIGKEIAFHLAKMGAHVVVTARSKETLQEVVAHCLKLGAASAHYIAGTMEDMTFAEQFVAKAGKLMGGLDMLILNHITNASLMFFNNDIHHVRKEMEVNFLSYVVLTVAALPMLKQSNGSIVVVSSLAGKIAHPLIAPYSASKFALDGFFSAIRKEHALTNVNVSITLCVLGLIDTDTAMKEVSGKIDMKAAPKEECALEIIKGGALRQDEVYYGNLQWTPLLLGNPGKRLIEFLHLRKFDISKLVNN

SEQ ID NO: 3061 - protein, 43 aa, Mus musculus
KRKLDNVLLVIFLGSSLFLVAYLGMVNIKKIAWMSIHEGNVTT

SEQ ID NO: 3062 - protein, 44 aa, Mus musculus
LLVIFLGSSLFLVAYLGMVNIKKIAWMSIHEGNVTTKSKLKHVT

SEQ ID NO: 3063 - protein, 62 aa, Anopheles gambiae
KQEMMVRSAIKYWVERHKHVVRLVSAIGDTYGPALLLHMLTSTIKLTLLAYQATKIDGVNVY

SEQ ID NO: 3064 - protein, 63 aa, Anopheles gambiae
KQEMMVRSAIKYWVERHKHVVRLVSAIGDTYGPALLLHMLTSTIKLTLLAYQATKIDGVNVYG

SEQ ID NO: 3065 - protein, 433 aa, Danio rerio
MSANSFKLLVKNATQLVLVCRNGEKYLTRDEMQALAVLENASVLIGHDGLIKAVGPADVIETQFEGAKFDNVLDASGMCVLPGLVDAHTHPVWAGDRVHEFAMKLAGATYMEVHEAGGGIHFTVAHTRSASEQHLLAALKSRLERMMRAGTTLVECKSGYGLELDIEVKMLRVINSARKSLPIGISATYCGAHAVPKGKTMEEATKDIVAVQLPKIKHLSASGDLQVDNIDVFCEKGVFDLTSTRCILQAGKDMGLNINFHGDELHPMNSAHLGAELGALAISHLEEVTDDGIVAMAKSKTSAVLLPTTAYILRLTPPRARDMLDAGVIVALGSDFNPNAYCFSMPMVMHLACVMMKMSMPEALAASTINAAYALNRSQTHGSLEVGKQGDLVIINAPRWEHLVYQFGGHQELIRYVIIKGDFVYENDKVLNL

SEQ ID NO: 3066 - protein, 394 aa, Danio rerio
MDSQGKKVVVCDNGTGFVKCGYAGSNFPEHIFPALVGRPIIRSTAKVGNIEIKDLMVGDEASELRSMLEVNYPMENGIVRNWDDMKHLWDYTFGPEKLNIDSRNCKILLTEPPMNPTKNREKIIEVMFETYQFSGVYIAIQAVLTLYAQGLLTGVVVDSGDGVTHICPVYEGFSLPHLTRRLDIAGRDITRYLIKLLLLRGYAFNHSADFETVRMMKEKLCYVGYNIEQEQKLALETTVLVESYTLPDGRVIKVGGERFGAPEALFQPHLINVEGVGVAELLFNTIQAADIDTRAEFYKHIVLSGGSTMYPGLPSRLERELKQLYLERVLKGDVDKLSKFKIRIEDPPRRKHMVFLGGAVLADIMKDKDNFWMTREEYQEKGTRVLEKLGVTVR

SEQ ID NO: 3067 - protein, 484 aa, Danio rerio
MGVISVQLVVTMVMASVIQKIIPHYSFARWLLCSGSLRWYQHPTEDELRTLAGKQQKGGKSKKDRKYNGHLENKPMTIPKDIDLQLETKCIAEVDTLALHYFPEFQWLVDFTVAATVVYLITELYFCVAEPSGEMNISVVWSLLVLAFVMKILFSLTAHYFRLEEGGERSLCITFAFFFFVKAMAILIVTENYLEFGLETGFANFSESAVQFLENQGLESQGPISKLTFKLILALLCALIGAFLTFPGLRLAQMHLDALTLNNCKVTQTLLHINFLAPLIMVLLWVKPITKDYITNPTFGKDNVPLMSEKTYDTLRLWVILLLCVLRLAMMRHHLQAYLNLAQKGVLQMKKEAGRISTVDLQKMVARVFYYLCVIALQYIAPLVMLLHTTLLLKTLGGHSWVIYSDESLPCLSNEDSSPAEVGQSQMEASQTVAQLSVALGGLRTVFSPLLFRGLLSFFTWWIAACLFSTSLFGLFYHQYLMAA

SEQ ID NO: 3068 - protein, 30 aa, Danio rerio
CKVTQTLLHINFLAPLIMVLLWVKPITKDY

SEQ ID NO: 3069 - protein, 109 aa, Danio rerio
LAGKQQKGGKSKKDRKYNGHLENKPMTIPKDIDLQLETKCIAEVDTLALHYFPEFQWLVDFTVAATVVYLITELYFCVAEPSGEMNISVVWSLLVLAFVMKILFSLTAH

SEQ ID NO: 3070 - protein, 196 aa, Danio rerio
VINKTVQAVIPALIKAHEGGSSQSEGHMETVVAQIIHVFVDALPHVPEHRRLPILSQLMSTLGPSRFLWVLMLLLFKQHVTQTSAGATGAEKEAVVERDQDFWILVCCEFEVKEQLTSLIKILQYLMTLPQDREEAPEKKKPRGRSAVKKDETVSDLIFSVETHSGKDLRHFKFISISFMAQLLASDGFVGKVADC

SEQ ID NO: 3071 - protein, 195 aa, Danio rerio
VQSKEVNKKLDKSISLFLTRLSPYFLLKPALKCIEWLLHRFHIHLYNQDSLIACVLPYHETKVFVRVIQLFKIEDPTHKWHWLHGIQKPGVPLARGTLLTHCYKDLGFMDFVCSMVTNSVKAYSELTRDGNCPQLRVIFSFYASTIVSALDAVEKITNSIIAKLLPFVQLGLKSNLSDYTAATYMIVCQMAVKVV

SEQ ID NO: 3072 - protein, 80 aa, Danio rerio
SEQKGNKIHDEHLFIVTHQAYELWFKQILWELDSVRDLFIKKHVRDERNMLKVVSRIHRITMIFKLLVDQFAVLETMTAL

SEQ ID NO: 3073 - protein, 54 aa, Danio rerio
FKQILWELDSVRDLFIKKHVRDERNMLKVVSRIHRITMIFKLLVDQFAVLETMT

SEQ ID NO: 3074 - protein, 344 aa, Xenopus laevis
MATPGALAKFRLPPLPTIGEIVKLFNLRAEKQLSQNFLLDLKLTDKIVRRAGNLQNAYVCEVGPGPGGITRSILNAGVEELLVVEKDTRFIPGLKMLNEASGGKVRTVHGDILTYRMDRAFPKHLIKSWDDEPPNVHIIGNLPFSVSTPLIIKWLEQVADRTGPFTYGRTQMTLTFQQEVAERLTASTKNKQRSRLSIMSQYLCNVKNCFTIPGRAFIPKPKVDVGVVHLTPFVQPKIEQPFKLVEKVVRCIFQFRRKYCHHGVSILFPEEIRIQLTEQMLRLADVDPTLRPTELTMTHFKKLCNVYREMCDQNPHLFSYNYREELRMKKLQGKSTEEEDDLLQ

SEQ ID NO: 3075 - protein, 375 aa, Danio rerio
MSVPAFIDITEEDQASELRSYLKSKGAEISEENSEGGLHVDLAQIIEACDVCLKDDDKDVESVMNSIVSLLLILETEKQEALIESLCEKLVKFREGERPSLRMQLLSNLFHGMDENTPVRHTVYCSLIKVAATCNAITFMPTDLDQVRKWIVDWNLNTEKKHTLLRLVYEALVDCKKSEAAAKVMVELLGSYTEDNASQARVDAHRCIVRALKDPNTYLFDHLLALKPVRFLEGELIHDLLTIFVSAKLISYVKFYQSNKDFIESLGLSHEQNMSKMRLLTFMGMAVEMKEISFETMQQELQIGAEDVEAFVIDAVRTKMVYSKIDQTQRKVVVSHSTHRTFGKQQWQQLYDTLCSWKQNLSTVKSSLQTLSPTA

SEQ ID NO: 3076 - protein, 450 aa, Danio rerio
MHPIHLLRIVSSVRRLLQTNRCRSFSSCQHNMASIKHKNARRIEGLDKNVWVAFTSVAADPSIVNLGQGYPDIPPPSYVKEGLAQAAMVDRLNQYTRGFGHPTLVKALSKVYGKVYDRQLDPFKEILVTVGGYGSLFSTMQALVEEGDEVIIIEPFFDCYVPMVKMAGAKPVLIPLRLKSTATTGISSADWVLDQEELASKFNSKTKAIIVNTPNNPIGKIFSRSELQAIADLCIKHDTLCFSDEVYEWLIYKGHEHVKIATLPGMWDRTITVGSAGKTFSVTGWKLGWSIGPEHLIRHLQTVMQNSLYTCPTPLQEAVGRGLLRDFELMGQPDCYFSALALELEGKRDRMAAMLAQTGMTPVVPEGGYFMIVDVTALNQDLTHMGDDEPYDYKFVKWMIKEKKLAAIPVTAFVGEDSVKQFEKYIRLCFIKQESTLDAAEAILKNWNKG

SEQ ID NO: 3077 - protein, 470 aa, Mus musculus
MRLWTLGTSIFLRLWGTYVFPRSPSWLDFIQHLGVCCFVAFLSVSLFSAAFYWILPPVALLSSVWMITCVFLCCSKRARCFILLAVLSCGLREGRNALIAAGTGVVIFGHVENIFYNFRGLLDSMTCNLRAKSFSVHFPLLKRYTEAIQWIYGLATPLNLFDDLVSWNQTLVVSLFSPSHALEAHMNDTRGEVLGVLHHMVVTTELLTSVGQKLLALAGLLLILVSTGLFLKRFLGPCGWKYENVYITKQFVRFDEKERHQQRPCVLPLNKKERKKYVIVPSLQLTPKEKKTLGLFFLPVLTYLYMWVLFAAVDYLLYRLISSMNKQFQSLPGLEVHLKLRGEKQGTQGVVHDSAFNISMFEPSCIPKPRLSVSETWVPLSIILLTLIILGLLSSMLMQLKILVSVSFYPKVERERIEYLHAKLLEKRSKQPLREADGKPSLYFKKIHFWFPVLKMIRKKQTIPANEDDL

SEQ ID NO: 3078 - protein, 387 aa, Mus musculus
MRLWTLGTSIFLRLWGTYVFPRSPSWLDFIQHLGVCCFVAFLSVSLFSAAFYWILPPVALLSSVWMITCVFLCCSKRARCFILLAVLSCGLREGPSHALEAHMNDTRGEVLGVLHHMVVTTELLTSVGQKLLALAGLLLILVSTGLFLKRFLGPCGWKYENVYITKQFVRFDEKERHQQRPCVLPLNKKERKKYVIVPSLQLTPKEKKTLGLFFLPVLTYLYMWVLFAAVDYLLYRLISSMNKQFQSLPGLEVHLKLRGEKQGTQGVVHDSAFNISMFEPSCIPKPRLSVSETWVPLSIILLTLIILGLLSSMLMQLKILVSVSFYPKVERERIEYLHAKLLEKRSKQPLREADGKPSLYFKKIHFWFPVLKMIRKKQTIPANEDDL

SEQ ID NO: 3079 - protein, 80 aa, Mus musculus
KKLEPVLLPGEIVVNEVNFVRKCIATDTSQYDLWGKLICSNFKISFITDDPMPLQKFHYRNLLLGEHDVPLTCIEQIVTV

SEQ ID NO: 3080 - protein, 84 aa, Mus musculus
KKLEPVLLPGEIVVNEVNFVRKCIATDTSQYDLWGKLICSNFKISFITDDPMPLQKFHYRNLLLGEHDVPLTCIEQIVTVNDHK

SEQ ID NO: 3081 - protein, 720 aa, Mus musculus
MLPFAPVEDPWDQEDMEVFGSTSSSEPQVVFTMKNAATVMREHERKEVNDLKMVDEPMEEGEPVSCRREELVKEVPITQHVKEGYEKADPAQFDLLKVLGQGSFGKVFLVRKKTGPDAGQLYAMKVLRKASLKVRDRVRTKMERDILVEVNHPFIVKLHYAFQTEGKLYLILDFLRGGDVFTRLSKEVLFTEEDVKFYLAELALALDHLHRLGIVYRDLKPENILLDEIGHIKLTDFGLSKESVDQEKKAYSFCGTVEYMAPEVVNRRAHSQSADWWSYGVLMFEMLTGTLPFQGKDRNETMNMILKAKLGMPQFLSAEAQSLLRMLFKRNPANRLGSEGVEEVKRHAFFASIDWNKLYKREVQPPFRPASGKPDDTFCFDPEFTAKTPKDSPGLPASANAHQLFKGFSFVATSIAEEYKITPVTSSNVLPIVQINGNAAQFSEAYELKEDIGIGSYSVCKRCIHSASNVEFAVKIIDKNKRDPSEEIEILMRYGQHPNIISLKEVFDDGKYVYLVTDLMKGGELLDRILKKKCFSEQEASNVLYVITKTVECLHSQGVVHRDLKPSNILYMDESAHPDSIKICDFGFAKQLRGENGLLLTPCYTANFVAPEVLTQQGYDAACDIWSLGVLLYTMLAGYTPFSNGPNDTPEEILLRIGNGRFSLSGGIWDNISRGAKEAVAAPYSVLARNPNRHHPILEPVTASRLAQRRNMKKRTSTGL

SEQ ID NO: 3082 - protein, 155 aa, Rattus norvegicus
MAARAACVAVCRRLQQITTSDEPDTLYKRLSILVKAHDKAVLDSYEYFAVLAAKELGLSIKVHEPPRKIERFTLLKSVHIFKKHRVQYEMRTLYRCLELKHLTGCTANVYLEYIQRNLPEGVAMEVTKTQIQQLPEHIKEPMWETVSGEKEETKS

SEQ ID NO: 3083 - protein, 309 aa, Mus musculus
MSQNLESVKNLLVFLGKSLLSVLEALLFHVISKPRKNVAGEIVLITGAGSGLGRLLALQFARLGAVLVLWDVNKEANDETHQLAREAGAARVHAYTCDCSRREEVYRVADQVKKEVGDVSILINNAGIVTGRNFLDCPDDLMEKSFDVNFKAHLWMYKAFLPAMIANNHGHLVCISSSAGLIGVNGLSDYCASKFAALGFAESMFIETLAKKQWGIKTTIVCPFFIKTGMFEGCTTKCPTLLPILDPEYAVRKIIDAILQEQLYLYMPKFLYFIVFLKSILPIKTGILIADYLGVFHMTEGFTGQKKKT

SEQ ID NO: 3084 - protein, 32 aa, Mus musculus
KIIMWTIPTVVFSIFMSLLLVSLVRHMKKTFL

SEQ ID NO: 3085 - protein, 48 aa, Mus musculus
KIIMWTIPTVVFSIFMSLLLVSLVRHMKKTFLALSELRDVWAQAHFKA

SEQ ID NO: 3086 - protein, 83 aa, Mus musculus; identical to SEQ ID NO: 2502

SEQ ID NO: 3087 - protein, 173 aa, Mus musculus
MEEMPLRESSPQRAERCKKSWLLCIVALLLMLLCSLGTLIYTSLKPTAIESCMVKFELSSSKWHMTSPKPHCVNTTSDGKLKILQSGTYLIYGQVIPVDKKYIKDNAPFVVQIYKKNDVLQTLMNDFQILPIGGVYELHAGDNIYLKFNSKDHIQKTNTYWGIILMPDLPFIS

SEQ ID NO: 3088 - protein, 476 aa, Mus musculus
MYVFPKISLRPEVENYLKESFLNEEAVSASSRQEAERKFETLLLRLSHPPSMTTVRVNTHLGSVQHVRGLLLEELQKQFGESSIPVVQHPALPDVLLIPMTGPRKNIERQQGEVIVGAQCGNAVLRGAHVYVPGIVSASKFMKAGDVISVYSDINGKCKKGAKEFDGTKVFLGNGISELSRKDIFNGLPDLKGIGIRMTEPIYLSPSFDNVLPSYIFLQNLPSTVVAHVLDPQPGEKILDMCAAPGGKTTHTAALMQDKGEVIALDKILTKVNKLKQNASLLGLHSIRAFCFDATKALKLDTTDGIEGGPPFLPESFDRIILDAPCSGMGQRPNMACTWTLKEVTSYQPLQRKLLHVAVQLLKPGGVLVYSTCTITLAENEEQVAWALRTFPCLQLQPQEPQIGGEGMVGAGLTLEQLKQLQRFDPSVVPLQNMDTDSLGEARREDMIWLANKDCIGFFIAKFLKCQSTKAKVSQK

SEQ ID NO: 3089 - protein, 404 aa, Mus musculus
MTSLSVFRDVPTAQKLEGSLLKIYRQDGYPSKLFLAYKVCMTEEGHPWVSLVVHKTRLQIAEDPSLDYEYLPLVGLKSFIQSSLELLFGKHSEAIAEKRVGGVHIVGESGAFQLGAQFLKTWRKNVKIVCIVSCQKEQCGLIFQDMGFIVYEYSIWNASDLCSDPSMFVEVLQHIPVGSILVIGNITDCKFTQNQWTKLMSIIKSKQIFPFFDIPCQGLSTGDLEEDTKILQYFVSLGLEFFCSQSLSKNFGIYDEGVGILVVAALSNQHLLCVLSQLMDYVQALWGNPPATGARIITSILCNPALFGEWKQSLKGVVENMMLIKEKVKEKLRLLGTPGSWDHITRQSGTHGYLGLTYQQVEFLVKKKHIYLPKTSRINFTCINARNIDYITQSIHEAVMLTEG

SEQ ID NO: 3090 - protein, 124 aa, Mus musculus
IYDEGVGILVVAALSNQHLLCVLSQLMDYVQALWGNPPATGARIITSILCNPALFGEWKQSLKGVVENMMLIKEKVKEKLRLLGTPGSWDHITRQSGTHGYLGLTYQQVEFLVKKKHIYLPKTS

SEQ ID NO: 3091 - protein, 114 aa, Mus musculus
VGILVVAALSNQHLLCVLSQLMDYVQALWGNPPATGARIITSILCNPALFGEWKQSLKGVVENMMLIKEKVKEKLRLLGTPGSWDHITRQSGTHGYLGLTYQQVEFLVKKKHIY

SEQ ID NO: 3092 - protein, 103 aa, Mus musculus
TKLILQMPRGNLEVVHHRALVLAQIRKWLDKLMFKEAFECMRKLRINLNLIHDHNPKVFLENVETFVKQIDSVNHINLFFTELREEDVTKTMYPPPITKSVQV

SEQ ID NO: 3093 - protein, 143 aa, Mus musculus
WLDKLMFKEAFECMRKLRINLNLIHDHNPKVFLENVETFVKQIDSVNHINLFFTELREEDVTKTMYPPPITKSVQVSTHPDGKKLDLICDAMRAAMEAINPRKFCLSILTSHVKKTTPELEIVLQKVQELQGNLPFDPESVSV

SEQ ID NO: 3094 - protein, 100 aa, Rattus norvegicus
VGLEEGLYVIELTRDVIVRAADCKKVYQIELAPKEKLILLLCGRNHHVHLYPWTSFDGAEASNFDIKLPETKGCQLIATGTLRKSSSTCLFVAVKRLVLC

SEQ ID NO: 3095 - protein, 86 aa, Rattus norvegicus
VIELTRDVIVRAADCKKVYQIELAPKEKLILLLCGRNHHVHLYPWTSFDGAEASNFDIKLPETKGCQLIATGTLRKSSSTCLFVAV

SEQ ID NO: 3096 - protein, 217 aa, Staphylococcus carnosus
MKIVIADDHAVVRTGFSMILNFQDDMEVVDTAADGVEAYQKVMQHQPDVLIMDLSMPPGESGLIATSKIVESFPDTKILILTMYDDEEYLFHVLRNGAKGYILKNAPDEQLISAVRTVYRGDTYIDPKMTTSLVNEFVNNTGQDANSTNDPFRILSKRELEILPLIAKGYGNKEIAEKLFVSVKTVEAHKTHIMQKLNLKSKPELVEYALKKKLLDF

SEQ ID NO: 3097 - protein, 328 aa, Solanum habrochaites
MAVNGASSSGLIVSFGEMLIDFVPTVSGVSLAEAPGFLKAPGGAPANVAIAVTRLGGRSAFVGKLGDDEFGHMLAGILKTNGVQADGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILADEARLKEVLRFSCACGAITTTKKGAIPALPTASEALTLLKGGA

SEQ ID NO: 3098 - protein, 37 aa, Oryza sativa
QTYEENSVGAKIKRWLEAHAYKRNCLLIVVLIGTCTA

SEQ ID NO: 3099 - protein, 37 aa, Oryza sativa
LGCFPRVKIVHTSKKFLGQIYIPDINWVLLILCIAVT

SEQ ID NO: 3100 - protein, 623 aa, Oryza sativa
MAKKNYGQVYNILGWGDPYFTVNSHGHLAVKPHGRDTMSGQDIDVHSVIHRALATTITTNDGDKKPQFPMILRFPDVLKNRLDSLHAAFHGAVDSTGYASRYQGVFPIKVNQNKAVVQDLVTFGHGYSYGLEAGSKPELLIAMSCLAKAKPGAYLVCNGYKDADYVALALSARAMGLNAIIVLEMEEELDIVVEQSARLGVEPVIGVRAKLLTKIPGHFGSTAGKHGKFGMLADKIYEVAGKLKKMGKLHWLKLLHYHVGSMIPTTDIVYNAAAEAAGIYCALVKEHGATGMTTLDCGGGLGVDYDGTRSGSSDMSVAYGLEQYASSIVQAVRLTCDDNGVPHPVLCTESGRAMASHHSMIILEALSAIPEPQDEEDTHHRLLSKIQDLSSKQPRTAHTVNGGGGVDAMHSHAVELKKHGIEMYKLAKKLSKRVTGDANGIYNYHMNLSVFSLVPDFWGIGQLFPMMPVSRLNEKPTINGTLVDITCDSDGKVEKFIRDAVTLPLHPLDDAAAEHGGYYVAALLSGAYQEALACKHNLFSGPTLVRVESAGGGGAFKIVSVELGPTAEEVIGTMRYDVKNDISDVIEKVATENGVWPMVEPLMKKGLTTMPYLNDYKPPKTTF

SEQ ID NO: 3101 - protein, 156 aa, Oryza sativa
LNAIIVLEMEEELDIVVEQSARLGVEPVIGVRAKLLTKIPGHFGSTAGKHGKFGMLADKIYEVAGKLKKMGKLHWLKLLHYHVGSMIPTTDIVYNAAAEAAGIYCALVKEHGATGMTTLDCGGGLGVDYDGTRSGSSDMSVAYGLEQYASSIVQAV

SEQ ID NO: 3102 - protein, 115 aa, Oryza sativa
LDIVVEQSARLGVEPVIGVRAKLLTKIPGHFGSTAGKHGKFGMLADKIYEVAGKLKKMGKLHWLKLLHYHVGSMIPTTDIVYNAAAEAAGIYCALVKEHGATGMTTLDCGGGLGV

SEQ ID NO: 3103 - protein, 62 aa, Oryza sativa; identical to SEQ ID NO: 1757

SEQ ID NO: 3104 - protein, 55 aa, Oryza sativa; identical to SEQ ID NO: 1758

SEQ ID NO: 3105 - protein, 123 aa, Artemisia spiciformis
QTASGQMIDLITTLVGEKDLSKYSLSIHRRIVQYKTAYYSFYLPVACALLMFGEDLDKHVEVKNVLVEMGTYFQVQDDYLDCFGAPEVIGKIGTDIEDFKCSWLVVKALELANEEQKKTLHEN

SEQ ID NO: 3106 - protein, 115 aa, Artemisia spiciformis
MIDLITTLVGEKDLSKYSLSIHRRIVQYKTAYYSFYLPVACALLMFGEDLDKHVEVKNVLVEMGTYFQVQDDYLDCFGAPEVIGKIGTDIEDFKCSWLVVKALELANEEQKKTLH

SEQ ID NO: 3107 - protein, 210 aa, Sus scrofa
MAVLGSPLLPLRLFLCFGLLFFSASCTDHPDQCMIFNKVTSIHNSRIQVNPKVYESNTVYTVSVPVNNTISSVVMKAVDMHHSVIGFWQKADMNCTSSALYHVKSPHEHVLEAKWLSPASTNINTVELQVFVVDFHKEATASVLKLEKSGTSPALITKLITTKSNTVTTTKPTVITTHTTHKNSANRVFRSPVRDAIQILLAFLTSKLLF

SEQ ID NO: 3108 - protein, 334 aa, Felis catus
MSEPIRVLVTGAAGQIAYSLLYSIGNGSVFGKDQPIILVLLDITPMMGVLDGVLMELQDCALPLLKDVIATDKEDVAFKDLDVAILVGSMPRRDGMERKDLLKANVKIFKCQGAALEKYAKKSVKVIVVGNPANTNCLTACKSAPSIPKENFSCLTRLDHNRAKAQIALKLGVTSDDVKNVIIWGNHSSTQYPDVSHAKVKLHGKEVGVYDALKDDSWLKGEFITTVQQRGAAVIKARKLSSAMSAAKAICDHVRDIWFGTPEGEFVSMGIISDGNPYGVPDDLLYSFPVTIKNKTWKVVEGLTINDFSREKMDLTAKELAEEKETAFEFLSSA

SEQ ID NO: 3109 - protein, 497 aa, Equus caballus
MFAKATRSFLREVDAEGDLIAVSNLNDSDKSQLLSLVTKKKRFWCWQRPKYQFLSVTLGDVLTEAQCLSPVVVESDFVKYEGKFENHVSGTIETALGKVKLNFGDKGLRESQSSFGTLRKQEVDLQQLIRDSVERTINLKNPVLQQMLESKNEVLCILTQKIVTTQKCVISEHIQTEEKCGGMVGIKTKTVQVSVTKDENIIKDASVALEIPAPTTIAYSVIELYVKLDGQFEFCLLRGKHGGFEHQRRSDIVFPDAGALQDFPFWDVPDAGQGLPTPDGPLSVLKQGTRLLEKNFFPFVELPEQHRTALNTVLQAVLSDEELLAVLEQVCDDLVHSLSPPLAMLGELKPPHRQDLTAFLRLVGYRVQGGCPCLEDGVGSQKLFSTAYFLVSALAEMPDNAAALLGTCCKLQIIPALCHLLHAMSHDGVCDLEDPALAPLKDTERFGVAQRLFASADINLERVQSSVKAVTPLKDPSVLPLILYISLKGLCALGREH

SEQ ID NO: 3110 - protein, 391 aa, Sus scrofa
MSRVFKKTCSNGKLSIYLGKRDFVDHVDMVEPIDGVVLVDPEYLKGRKMFVMLTCAFRYGHDDLDVIGLTFRKDLYVQVQQVVPAEPTSPQVPLTVLQERLLHKLGDNAYPFNLQMVVNLPCSVTLQPGPDDTGKACGIDFEVKSFCAENLEEKVSKKDSVRLVIRKIQFAPVEPGPGPWAQTVRRFLLSAQPLQLQAWMDREVHYHGKPISVNVSINNSTNKVIKKIKISVDQITDVVLYSLDKYTKTVFIQEFTETIAANSTFSKSFEVTPLLADNCEKQGLALDGKLKHGDTNLASSTILRPGMDKELLGILVSYKVRVNLMVSCGGILGDLTASDVGVELPLILMHPKPSNEAASSEDIVIEEFARQEPGGREESQEALAAEGDEGS

SEQ ID NO: 3111 - protein, 394 aa, Xenopus laevis
MDSQGKKVVVCDNGTGFVKCGYAGSNFPEHIFPALVGRPVIRSTAKVGNIEIKDLMVGDEASELRSMLEVNYPMENGIVRNWDDMKHLWDYTFGPEKLNIDTRDCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRVIKVGGERFEAPEALFQPHLINVEGVGVAELLFNTIQAADIDTRAEFYKHIVLSGGSTMYPGLPSRLERELKQLYLERVLKGDVEKLSKFKIRIEDPPRRKHMVFLGGAVLADIMKDKDNFWMTRQEYQEKGTRVLEKLGVTVR

SEQ ID NO: 3112 - protein, 182 aa, Danio rerio
MLVLVLGDLHIPHRCNTLPAKFKKLLVPGKIQHILCTGNLCTKESYDYLKTLAGDVHIVRGDFDENLNYPEQKVVTVGQFKIGLIHGHQVIPWGDMASLALLQRQLDVDILISGHTHKFEAFENENKFYINPGSATGAYSALESNITPSFVLMDIQASTVVTYVYQLIGDDVKVERIEYKKS

SEQ ID NO: 3113 - protein, 87 aa, Danio rerio
CNTLPAKFKKLLVPGKIQHILCTGNLCTKESYDYLKTLAGDVHIVRGDFDENLNYPEQKVVTVGQFKIGLIHGHQVIPWGDMASLAL

SEQ ID NO: 3114 - protein, 96 aa, Danio rerio
MLVLVLGDLHIPHRCNTLPAKFKKLLVPGKIQHILCTGNLCTKESYDYLKTLAGDVHIVRGDFDENLNYPEQKVVTVGQFKIGLIHGHQVIPWGDM

SEQ ID NO: 3115 - protein, 394 aa, Xenopus laevis
MDSQGKKVVVCDNGTGFVKCGYAGSNFPEHIFPALVGRPVIRSTAKVGNIEIKDLMVGDEASELRSMLEVNYPMENGIVRNWDDMKHLWDYTFGPEKLNIDTRDCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMMKEKLCYVGYNIEQEQKLALETTVLVESYTLPDGRVIKVGGERFEAPEALFQPHLINVEGVGVAELLFNTIQAADIDTRAEFYKHIVLSGGSTMYPGLPSRLERELKQLYLERVLKGDVEKLSKFKIRIEDPPRRKHMVFLGGAVLADIMKDKDNFWMTRQEYQEKGTRVLEKLGVTVR

SEQ ID NO: 3116 - protein, 515 aa, Xenopus laevis
MSSYKPLAIPTYPKLGEKITQDTLYWKRYKTPVQIKEFGAVTKIHFSPIQPFSYAVTSSTRIHLYGQYSQEPVKTFSRFKDTAYCGTYRGDGKLLAAGCEDSVVQLFDISGKAALRQFSGHSKAVHFVDFTSDKYRIVSGSDDYTSKLWDIPNGIEIASYKEHTDYIRCGCTSSLNNDLFATGSYDHTIKVFDGRTDKSVMSMDHGQPVESVLLFPSGGLLVSAGGRYVKVWDILKGGQLLVSLRNHHKTVTCLCLSSSGQRLLSGSLDRHVKVYSTMNYKVVHSFDYAASILSLALAPDDQMIVVGMTNGVLNIKHRKPEERKPLQSTTKRHPRYRVFVRGKDYMPKQDDIYVSKPVREHLKKYDQLLKGFHMSKALDAVLQSQIRTKKPEVTVAVMNELKRRGTLKNALAGRNEKELSDLLIFLLKHLVNPLFLPILLNVAEHIIDIYSPVVGQSSVIHKQFIRLQEVVEKEINYQEELLKILGMMDTLFATMTTKKESPWEEPKPILPLGSQ

SEQ ID NO: 3117 - protein, 473 aa, Xenopus laevis
MLEQVQKFLLSRAACEGSDSHTRYAELFHKLDVNKDGKVDILELQEGLKAMGMAVGKGAEEKIVEAGDTNKDGHLDFGEFMRYLEEHEKKMKIAFTSLDKNKDGKIESSEVMNSLKTLGINISLDHAEKILKSMDSDGTLTVDWNEWRDHFLFNPADNIQQIIRFWKHSTVLDIGDSLTIPDEFTEEEKKTGQWWKHLLAGGMAGAVSRTGTAPLDRLKVMMQVHGTKGNSNIITGLKQMVKEGGVRSLWRGNGVNVIKIAPETAMKFWAYEQYKKLFTSESGKLGTAERFIAGSLAGATAQTSIYPMEVLKTRLAVGKTGQYSGMFDCAKKIMQKEGILAFYKGYIPNILGIIPYAGIDLAIYETLKNYWLQNYAKDSANPGVLVLLGCGTVSSTCGQLASYPLALIRTRMQAQASIEGAPQLNMGGLFRKIVAKEGFFGLYTGIAPNFLKVLPAVSISYVVYEKMKIQLGI

SEQ ID NO: 3118 - protein, 739 aa, Xenopus laevis
MAAVISNSSGTELYVDPTKAIPDLCINDVVLSTPPCYAEETLVQPSAEINTSNSSEKPIVPEISSSDVMVHSAVENLPTSDMKLWTAQRDSAVKLRLEDSDVASLPPVTIHQLFQETVNKYGDYVALASKQGDQWHKMSYKQYYEQCRIAAKGFIKLGLERYHGVGILGFNSAEWFIADVGAIFAGGFAVGIYTTNSAEACHYVAQNCEANIIVVENQKQLQKILQVQDQLPHLKAIIQYKDELKEKRPNLYTWKEFMQLGKDIPDSQLDQIISSQKPNQCCTLIYTSGTTGQPKGVMLSHDNITWTAAAAGKTVRLREATDLQEIVVSYLPLSHIAAQMIDIWLTMKYGGATYFAQPDALKGSLAITLREVRPTAFMGVPRVWEKMQEKMKAVGAKSSTIKRKMATWAKGVGLETNLKKMNGSTPHPMKYHVANKLVFKKVRKALGLDRCTKCYTGAAPITKDTLEFFLSLNIPVYELYGMSESSGPHTISLPDAFRITSCGKVISGCKTKIHQPDSDGSGEILFWGRHVFMGYLNMEDKTHESLDEEGWLHSGDIGKHDENGFLYITGRIKELIITAGGENIPPVPTEDAVKEQVPIISNAMLIGDKKKFLSMLLTLKCNVNADTGEPEDELTPEAIQFCRQIGSKATLVSDIVGGKDTAVYAAIQEGVNSVNEKSTSNAQKVQKWLILEKDFSITGGELGPTMKLKRPVVAKMYKDQIDSFYQDAGTPTENFTPPK

SEQ ID NO: 3119 - protein, 374 aa, Xenopus laevis
MSVPAFIDVTEEDQAAELRAYLKSKGAEISEENSEGGLHIDLAQIIEACDVCLKDDDKDVESSMNSVVSLVLILETDKQEALIESLCEKLVKSREGERPSLRLQLLSNLFHGMDKSIPARYTVYCALIKVAATCGGIVYIPTDLDQVRKWISDWNLSTEKKHVVLRLLYEALVDCKKSDEAAKVMVELLGSYTDDNASQARLDAHKCIVRALKDPKAFLLDHLLALKPVKFLEGELIHDLLTIFVSAKLSSYVKFYQNNKDFIDSLGLSHEQNMEKMRLLTFMGMAVDNKEISFDTIQQELQMGADEVEAFIIDAVKTKMVYCKIDQTQKKVVVSHSTHRTFGKQQWQQLYDILNTWKLNLNKVKNSLYSISDA

SEQ ID NO: 3120 - protein, 85 aa, Xenopus laevis
LQLLSNLFHGMDKSIPARYTVYCALIKVAATCGGIVYIPTDLDQVRKWISDWNLSTEKKHVVLRLLYEALVDCKKSDEAAKVMVE

SEQ ID NO: 3121 - protein, 71 aa, Xenopus laevis
LSNLFHGMDKSIPARYTVYCALIKVAATCGGIVYIPTDLDQVRKWISDWNLSTEKKHVVLRLLYEALVDCK

SEQ ID NO: 3122 - protein, 153 aa, Danio rerio
MVILKGIPSVLTPELLYVLAQMGHGDELVLADANFPTSSVCKCGPVEIRADGVRIPELLKAILKLFPLDTYDESAAVMDLVPSDLLKGLKVPIWDQYSELLKQAGSDGNMKPVERFAFYERAKKAFAVVATGETALYGNLIIKKGVIPPEEQC

SEQ ID NO: 3123 - protein, 164 aa, Xenopus laevis
MESVLKSLFVLLVATSFTLAKEIPAKVSKPQTLSRGWGDNLEWVQTYEEGLYKAKAENKPLMLINHRNDCPHSLALKKAFAEHQGIQKLAEEFILLNVVYDPTDKNLQLDGQYVPKIIFVDPSLVVRADLPGKYSNHQYTYEPADIDHLFENMKKALVLLKTEL

SEQ ID NO: 3124 - protein, 130 aa, Mus musculus; identical to SEQ ID NO: 2846

SEQ ID NO: 3125 - protein, 48 aa, Mus musculus; identical to SEQ ID NO: 2847

SEQ ID NO: 3126 - protein, 464 aa, Mus musculus
MASVPVYCLCRLPYDVTRFMIECDMCQDWFHGSCVGVEEEKAADIDLYHCPNCEVLHGPSIMKKRRGSSKGHDNHKGKPLKTGSSMFIRELRGRTFDSSDEVILKPTGSQLTVEFLEENSFSVPILVLKKDGLGMTLPSPSFTVRDVEHYVGSDKEIDVIDVARQADCKMKLGDFVKYYYSGKREKVLNVISLEFSDTRLSNLVETPRIVRKLSWVENLWPEECVFERPNVQKYCLMSVRDSYTDFHIDFGGTSVWYHVLKGEKIFYLIRPTNANLTLFECWSSSSNQNEMFFGDQVEKCYKCSVKQGQTLFIPTGWIHAVLTPVDCLAFGGNFLHSLNIEMQLKAYEIEKRLSTADLFKFPNFETICWYVGKHILDIFRGLRENRRHPASYLVHGGKALNLAFRAWTKKEALPDHEDEIPETVRTVQLIKDLAREIRLVEVRSMGEGKAFGKGWRLKWQVRTL

SEQ ID NO: 3127 - protein, 85 aa, Mus musculus
MVTLHKMIRSSSVLKPDSSRLDNIKSWALGAIALLFLLGLTWAFGLLFINKESVVMAYLFTTFNAFQGVFIFVFHCALQKKVHKE

SEQ ID NO: 3128 - protein, 85 aa, Mus musculus
GNESLDITIVKHLQYCTQLIQQIVFSSKTPFVARSLLEKLSRQVLVMQKLAAVSDENLGNITSVVEAIPEFHKKLSLLAFWTKCC

SEQ ID NO: 3129 - protein, 33 aa, Mus musculus
LGNITSVVEAIPEFHKKLSLLAFWTKCCSPSGV

SEQ ID NO: 3130 - protein, 74 aa, Rattus norvegicus; identical to SEQ ID NO: 2949

SEQ ID NO: 3131 - protein, 79 aa, Rattus norvegicus; identical to SEQ ID NO: 2950

SEQ ID NO: 3132 - protein, 467 aa, Mus musculus
MAAAAAARAVPVSSGFRGLRRTLPLVVILGATGTGKSTLALQLGQRLGGEIVSADSMQVYEGLDIITNKVSAQEQKMCQHHMISFVDPLVTSYTVVDFRNKATALIEDIFARDKIPIVVGGTNYYIESLLWKVLITTKPQEMGTGKVVDRKVELEKEDGHELHKRLSQVDPEMAAKLHPHDKRKVARSLQVFEETGISHSEFLHRQHAEEGGGPLGGPLRFPNPCILWLHADQAVLDERLDKRVDDMLAAGLLEELRGFHRRYNLKNISENSQDYQHGIFQSIGFKEFHEYLTTEGKCTPETSNQLLKKGIEALKQVTKRYARKQNRWVKNRFLSRPGPSVPPVYGLEVSDVSKWEESVLEPALNIVQSFIQGHKPTAMPVKMAYNESENKRSYHMCDLCDRIIIGDREWAAHLKSKSHLHQLKKRRRLDLDAVSATGSQSNSPDCDPERIEGESSGQHNQELKASV

SEQ ID NO: 3133 - protein, 356 aa, Mus musculus
MAPMGIRLSPLGVAVFFLLGLGVLYHLYSGFLAGRFSLFGLGSEPAAGEAEVASDGGTVDLREMLAVAVLAAERGGDEVRRVRESNVLHEKSKGKTREGADDKMTSGDVLSNRKMFYLLKTAFPNVQINTEEHVDASDKEVIVWNRKIPEDILKEIAAPKEVPAESVTVWIDPLDATQEYTEDLRKYVTTMVCVAVNGKPVLGVIHKPFSEYTAWAMVDGGSNVKARSSYNEKTPKIIVSRSHAGMVKQVALQTFGNQTSIIPAGGAGYKVLALLDVPDMTQEKADLYIHVTYIKKWDICAGNAILKALGGHMTTLNGEEISYTGSDGIEGGLLASIRMNHQALVRKLPDLEKSGH

SEQ ID NO: 3134 - protein, 1122 aa, Mus musculus
MSDMVERTLTALPGLFLQNQLGGPAASRAPFFSRLGGLIRGVTALSSKHEEEKLIQQELSSLKATVSAPTTTLKTMKECMVRLIYCEMLGYDASFGYIHAIKLAQQGNLLEKRVGYLAVSLFLHESHELLLLLVNTVVKDLQSTNLVEVCMALTVVSQIFPREMIPAVLPLIEDKLQHSKEIIRRKAVLALYKFYLIAPNQVQHIHTKFRKALCDRDVGVMAASLHIYLRMIKENASGYKDLTESFVTILKQVVGGKLPVEFSYHSVPAPWLQIQLLRILGLLGKDDERTSELMYDVLDESLRRAELNHNVTYAILFECVHTIYSIYPKSELLEKAAKCIGKFVLSPKINLKYLGLKALTYVIQQDPSLALQHQITIIECLDHPDPIIKRETLELLYRITNAQNVVVIVQKMLEYLHQSKEEHIIISLVGRIAELAEKYAPDNVWFIQTMNAVFSVGGDVMHPDILSNFLRLLAEGFDDETEDQQLRLYAVQSYLTLLDMENTFYPQRFLQVMSWVLGEYSYLLDKESPEEVITRLYKLLMSDSISSETKAWLFAAVTKLTPQAHSSPLVEKLIQEFTVSLNTCLRQHAFELKHLHENTELMKSLLQGAQNCEDIVADASLSFLDGFVAEGLSQGAAPYKPHHQRQEEQLSQEKVLNFEPYGLSFSSSGFTGRQSPAGISLGSDISGNSAETGLKETSSLKMEGIKKLWGKEGYLPKKESGTGDKPEASHVPAEGATVENVDQATTRKDQAQGHIPSTEEKEKQLLASSLFVGLGPENTVDLLGKADVVSHKFRRKSKLKVAQSDKTPSAPTAPCSALSLGSDVAGGDEDGLSAVDRGDGELSSELFRSESLSGPPSAEKLESVSLPVPSLFADNNMEVFNPPSSSATSTVKEETPECRHSGLVEICSNEAVSVSSYKVWRDDCLLVIWAVTSKTDSEFTDAQLEIFPVENFKIIEQPECSSPVIETERTKSFQYSVQMESPCIEGTLSGFIKYQMMDTHSVQLEFSMNLPLLDFIRPLKISTEDFGKLWLSFANDVKQTIKISEPGVALTSVLTELQQNLRLRVIDVIGNEGLLACKLLPSTPCVLHCRVHADAVALWFRSSSSVLSDYLSCHCQKVMQTS

SEQ ID NO: 3135 - protein, 170 aa, Mus musculus
MTVPLGTMRATGDFVTVKDGEIFFLGRKDSQIKRHGKRLNIALVQQVAEELRQVESCAVTWYNQERLILFIVSKVDLVKDCIFKELQKHLPAHALPDDMVLIDTLPFTCHGKVDVSELNKIYLDYISSQPRNELHGKEELWGKLQYLWKSILCLPEDPEDTLKVPANSVF

SEQ ID NO: 3136 - protein, 55 aa, Mus musculus
VTWYNQERLILFIVSKVDLVKDCIFKELQKHLPAHALPDDMVLIDTLPFTCHGKV

SEQ ID NO: 3137 - protein, 774 aa, Mus musculus
MVGEGPYLISDLDRRGHRRSFAERYDPSLKTMIPVRPRARLAPNPVDDAGLLSFATFSWLTPVMIRSYKHTLTVDTLPPLSPYDSSDINAKRFQILWEEEIKRVGPEKASLGRVVWKFQRTRVLMDVVANILCIVMAALGPTVLIHQILQHITSISSGHIGIGICLCLALFTTEFTKVLFWALAWAINYRTAIRLKVALSTLIFENLLSFKTLTHISAGEVLNILSSDSYSLFEAALFCPLPATIPILMVVCAVYAFFILGSTALVGISVYLIFIPIQMFMAKLNSTFRRSAISVTDKRVQTMNEFLTCIKLIKMYAWEESFINTIHDIRKREKKLLEKAGYVQSGNSALAPIVSTIAIVSTFTCHIFLKRKLTAPVAFSVIAMFNVMKFSIAILPFSVKAVAEASVSLRRMKKILIAKSPPSYITQPEDPDTILLLANATLTWEQEINRKSDPPKAQIQKRHVFKKQRPELYSEQSRSDQGVASPEWQSGSPKSVLHNISFVVRKGKVLGICGNVGSGKSSLISALLGQMQLQKGVVAVNGPLAYVSQQAWIFHGNVRENILFGEKYNHQRYQHTVHVCGLQKDLNSLPYGDLTEIGERGVNLSGGQRQRISLARAVYANRQLYLLDDPLSAVDAHVGKHVFEECIKKTLKGKTVVLVTHQLQFLESCDEVILLEDGEICEKGTHKELMEERGRYAKLIHNLRGLQFKDPEHIYNVAMVETLKESPAQRDEDAVLASGDEKDEGKEPETEEFVDTNVEGTSGSQNVKIWRRKS

SEQ ID NO: 3138 - protein, 738 aa, Mus musculus
MVGEGPYLISDLDRRGHRRSFAERYDPSLKTMIPVRPRARLAPNPVDDAGLLSFATFSWLTPVMIRSYKHTLTVDTLPPLSPYDSSDINAKRFQILWEEEIKRVGPEKASLGRVVWKFQRTRVLMDVVANILCIVMAALGPTVLIHQILQHITSISSGHIGIGICLCLALFTTEFTKVLFWALAWAINYRTAIRLKVALSTLIFENLLSFKTLTHISAGEVLNILSSDSYSLFEAALFCPLPATIPILMVVCAVYAFFILGSTALVGISVYLIFIPIQMFMAKLNSTFRRSAISVTDKRVQTMNEFLTCIKLIKMYAWEESFINTIHDIRKREKKLLEKAGYVQSGNSALAPIVSTIAIVSTFTCHIFLKRKLTAPVAFSVIAMFNVMKFSIAILPFSVKAVAEASVSLRRMKKILIAKSPPSYITQPEDPDTILLLANATLTWEQEINRKSDPPKAQIQKRHVFKKQRPELYSEQSRSDQGVASPEWQSGSPKSVLHNISFVVRKGKVLGICGNVGSGKSSLISALLGQMQLQKGVVAVNGPLAYVSQQAWIFHGNVRENILFGEKYNHQRYQHTVHVCGLQKDLNSLPYGDLTEIGERGVNLSGGQRQRISLARAVYANRQLYLLDDPLSAVDAHVGKHVFEECIKKTLKGKTVVLVTHQLQFLESCDEVILLEDGEICEKGTHKELMEERGRYAKLIHNLRGLQFKDPEHIYNVAMVETLKESPAQRDEDAGTVR

SEQ ID NO: 3139 - protein, 528 aa, Mus musculus
MLKNILLCSLQISLLGMSLGGNVLIWPMEGSHWLNVKIIIDELLRKEHNVTVLVASGALFITPSSISPSLTFEIYPVPFGKEKIESVIKDFVLTWLENRPSPSTIWTFYKEMAKVIEEFHLVSRGICDGVLKNEKLMSKLQKEKFEVLLSDPVFPCGDIVALKLGIPFIYSLRFSPASTVEKHCGKVPFPPSYVPAILSELTDQMSFTDRVRNFISYRMQDYMFETLWKQWDSYYTKALGRPTTLCETMGKAEIWLMRTYWDFEFPRPYLPNFEFVGGLHCKPAKPLPKEMEEFVQTSGEHGIVVFSLGSMVKNLTDEKANLIASALAQIPQKVLWRYKGKIPDTLGSNTRLFDWIPQNDLLGHPKTRAFITHGGTNGIYEAIYHGIPMVGVPMFADQPDNIAHMKAKGAAVEVNMNTMTSSDLLNALRTVINEPSYKENAMRLSRIHHDQPVKPLDRAVFWIEFVMRHKGAKHLRVAAHDLSWFQYHSLDVIGFLLACVASAILLVAKCCLFIFQKVGKTGKKKKRD

SEQ ID NO: 3140 - protein, 918 aa, Mus musculus
MKVARFQKIPNVENETMIPVLTSKRASELAVSEVAGLLQADLQNGLNKSEVSHRRAFHGWNEFDISEDEPLWKKYISQFKNPLIMLLLASAVISILMRQFDDAVSITVAIVIVVTVAFVQEYRSEKSLEELSKLVPPECHCVREGKLEHTLARDLVPGDTVCLSVGDRVPADLRLFEAVDLSVDESSLTGETAPCSKVTAPQPAANGDLASRSNIAFMGTLVRCGKAKGIVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHILTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYNSKGQTLALTQQQRDLYQQEKARMGSAGLRVLALASGPELGQLTFLGLVGIIDPPRTGVKEAVTTLIASGVSIKMITGDSQETAIAIASRLGLYSKTSQSVSGEEVDTMEVQHLSQIVPKVAVFYRASPRHKMKIIKSLQKNGAVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNKMFCYAVLGSIMGQLLVIYFPPLQKVFQTESLSILDLLFLLGLTSSVCIVSEIIKKVERSREKVQKNAGSASSSFLEV

SEQ ID NO: 3141 - protein, 664 aa, Mus musculus
MNINHKGVLKLTKMEKKFLRKQSKARHVLLKHEGIQAVSYPTQSLVIANGGLGNGVSRKQLLLTLEKCGPVEALLMPPNKPYAFVIFQTIEESKKAYFTLNGKEIIDDLGQKIFLYLNFVEKAQWKNMGLEALPPGLLVVEEIISSEEEKKLLESVNWTEDTGNQNFQRSLKHRRVKHFGYEFHYESNTVDKDKPLPGGLPEVCSSILEKLLKEGYIKHKPDQLTINQYEPGHGIPAHIDTHSAFEDEIISLSLGSAIVMDFKHPEGVTVQVMLPRRSLLVMTGESRYLWTHGITPRKFDTVQASEQFKGGIITSDIGDLTLSKRGMRTSFTFRKVRRMPCNCSYSSVCDRQRKATPPSLTESSKEALELEQKHVHQVYNEIASHFSSTRHSPWPRIVEFLKALPSGSIVADIGCGNGKYLGINKDLYMIGCDRSQNLVDICRERQFQALVCDALAVPVRSGSCDACISIAVIHHFATAERRVEALQELARLLRPGGQALIYVWAMEQEYKNQKSKYLRGKRISQGDKDELNSATSTEEFLVNQTPEGVNEDPALSVNSSSITKEEEYKSRKVPNSELPIHINRTCFHSQDVLVPWHLKRNPGKDKAIEPSGVAGCPDPSPVFHRYYHVFCDGELEASCQAVGDVSILQSYYDQGNWCVVLQKV

SEQ ID NO: 3142 - protein, 169 aa, Mus musculus
MNINHKGVLKLTKMEKKFLRKQSKARHVLLKHEGIQAVSYPTQSLVIANGGLGNGVSRKQLLLTLEKCGPVEALLMPPNKPYAFVIFQTIEESKKAYFTLNGKEIIDDLGQKIFLYLNFVEKGTLTLASFNLLFLCEFSSYRESLSIILYVWEVCAGVLDHAVPVGVKG

SEQ ID NO: 3143 - protein, 77 aa, Rattus norvegicus
EFQKLKVGIHTKVWFIAGIFLLLTIPVSMCGILQHLVHYTQPELQKPIIRILWMVPIYSLDSWVALKYPKIAIYVDT

SEQ ID NO: 3144 - protein, 27 aa, Rattus norvegicus
KLKVGIHTKVWFIAGIFLLLTIPVSMC

SEQ ID NO: 3145 - protein, 70 aa, Mus musculus
KIAHAGWLKVVIGSLLIVYEISCVKEGLTLMTKGVPPRFMYPKEWQHLTMFFLLTLDGCVEMVSKNVLRQ

SEQ ID NO: 3146 - protein, 46 aa, Mus musculus
HAGWLKVVIGSLLIVYEISCVKEGLTLMTKGVPPRFMYPKEWQHLT

SEQ ID NO: 3147 - protein, 963 aa, Mus musculus
MDSPSAGYTFEYLIETLNGNSQKKFFNVPKLGGTKYDILPYSIRVLLEAAVRNCDGFLMKKEDVMNILDWKTKQSNVEVPFFPARVVLQDFTGIPAMVDFAAMREAVKTLGGDPKKVHPACPTDLTVDHSLQIDFSKCAIQNAPNPGGGDLQKAGKLSPLKVQSKKLPCRGQTTCRGSCDSGELSRNSGTFSSQIENTPVLCPFHLQPVPEPETVLKNQEVEFGRNRERLQFFKWSSGAFKNVAVIPPGTGMAHQVNLEYLSRVVFEETDLLFPDSVVGTDSHITMVNGLGILGWGVGGIETEAVMLGLPVTLTLPEVVGCELTGSSNAFVTSIDIVLGITKHLRQVGVAGKFVEFFGSGVSQLSIVDRTTIANMCPEYGAILSFFPVDNVTLRHLEHTGFDKTKLESMEKYLKAVKLFRNDENSSEPEYSQVIQINLNSIVASVSGPKRPQDRVAVTDMKSDFQACLNEKVGFKGFQVAAEKQSDTVSVRYDGSEYKLSHGSVVIAAVISCTNNCNPSVMLAAGLLAKKAVEIGLRVKPYIRTSLSPGSGMVTHYLSSSGVLPYLSKLGFDIVGYGCSTCVGNTAPLSEAVLNAVKQGDLVTCGVLSGNKHFEGRLCDCVRANYLASPPLVVAYAIAGTVNIDFQTEPLGTDSTGKEIYLHDIWPSREEVHQMEEEHVILSMFKTLKEKVEMGNKRWNSLEAPDSVLFPWDVKSTYIRCPSFFDKLTKEPAASQPIENAHVLLYLGDSVTTDHISPAGSIARSSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLEFLPGENADSLGLSGREVFSLSFPEELFPGITLNIKTSTGKEFSVIASFANDVEITLYKHGGLLNFVARKFL

SEQ ID NO: 3148 - protein, 345 aa, Rattus norvegicus
MAASGKLGTFRLPPLPTIREIIKLFGLRAAKQLSQNFLLDLRLTDKIVRKAGSLADVYVYEVGPGPGGITRSILNADIAELLVVEKDTRFIPGLQMLSDAAPGKLRIVHGDVLTYKIEKAFPDNIRRQWEDDPPNVHIIGNLPFSVSTPLIIKWLENISLKNGPFVYGRTKMTLTFQKEVAERLVATTGSKQRSRLSIMAQYLCNVEHLFTIPGKAFVPKPEVDVGVVHLMPLVQPKIKQPFKLVEKVVQNVFQFRRKYCHRGLGMLFPEAQRLESTGRLLQLADIDPTLRPTHLSLMHFKSLCDVYRKMCDEDPQLFAYNFREELKQKKRKGQEKDGDSESWGF

SEQ ID NO: 3149 - protein, 110 aa, Mus musculus
LVSLSSCFGGFHGLLEINNIVYEIMPKKFSRKFEHLVYKVDINKTESRGSSLMQDNITCQVELQKSGNPILKQSSFEDWWTHTKIVELVVVVDKTLYDHYGNYTVMLSDL

SEQ ID NO: 3150 - protein, 741 aa, Mus musculus
MAETVSPLKHFVLAKKAITAIFGQLLEFVTEGSHFVEATYRNPELDRIASEDDLVEIQGYRNKLAVIGEVLSRRHMKVAFFGRTSSGKSSVINAMLWDKVLPSGIGHTTNCFLSVEGTDGDKAYLMTEGSDEKKSVKTVNQLAHALHMDKDLKAGCLVHVFWPKAKCALLRDDLVLVDSPGTDVTTELDIWIDKFCLDADVFVLVANSESTLMNTEKHFFHKVNERLSKPNIFILNNRWDASASEPEYMEDVRRQHMERCLHFLVEELKVVSPSEARNRIFFVSAKEVLNSRKHKAQGMPEGGGALAEGFQARLQEFQNFEQTFEECISQSAVKTKFEQHTIRAKQILDTVKNILDSVNVAAAEKRVYSMEEREDQIDRLDFIRNQMNLLTLDVKKKIKEVTEEVANKVSCAMTDEICRLSVLVDEFCSEFHPTPSVLKVYKSELNKHIEDGMGRNLADRCTNEVNASILQSQQEIIENLKPLLPAGIQNKLHTLIPCKKFDLSYDLNCHKLCSDFQEDIVFRFSLGWSSLVHRFLGSTNAQRVLLGLSEPIFQVPRSLASTPTAPSNPAAPDNAAQEELMITLITGLASLTSRTSMGIIVVGGVIWKTVGWKLISVTLSMYGALYLYERLTWTTRAKERAFKQQFVNYATEKLQMIVSFTSANCSHQVQQEMATTFARLCQQVDVTQKHLEEEIARLSKEIDQLEKIQNNSKLLRNKAVQLESELENFSKQFLHPSSGES

SEQ ID NO: 3151 - protein, 414 aa, Bacillus cereus
MSGIIATYLIHDDSHNLEKKAEQIALGLTIGSWTHLPHLLQEQLKQHKGNVIHVEELAEHEHTNSYLRKKVKRGIIKIEYPLLNFSPDLPAILTTTFGKLSLDGEVKLIDLTFSDELKKHFPGPKFGIDGIRNLLQVHDRPLLMSIFKGMIGRNIGYLKTQLRDQAIGGVDIVKDDEILFENALTPLTKRIVSGKEVLQSVYETYGHKTLYAVNLTGRTFDLKENAKRAVQAGADILLFNVFAYGLDVLQSLAEDDEIPVPIMAHPAVSGAYSASKLYGVSSPLLLGKLLRYAGADFSLFPSPYGSVALEKEEALAISKYLTEDDASFKKSFSVPSAGIHPGFVPFIVRDFGKDVVINAGGGIHGHPNGAQGGGKAFRTAIDATLQNKPLHEVDDINLHSALQIWGNPSYEVKL

SEQ ID NO: 3152 - protein, 180 aa, Bacillus anthracis
MGNFHATTIFAVHHNGECAMAGDGQVTMGNAVVMKHTARKVRKLFQGKVLAGFAGSVADAFTLFEMFEGKLEEYNGNLQRAAVEMAKQWRGDKMLRQLEAMLIVMDKTTMLLVSGTGEVIEPDDGILAIGSGGNYALSAGRALKQYASEHLTAKQIAKASLEIAGDICVYTNHNIIVEEL

SEQ ID NO: 3153 - protein, 333 aa, Enterococcus faecalis
MKIAVDAMGGDNAPQAIVEGVMLAKQDFPDIEFQLYGKEAEIKKYITDEKNITIIHTDEKIASDDEPVKAIRRKKTASMVLAAQAVKNGEADAIFSAGNTGALLAAGLFIVGRIKNVERPGLMSTLPVMGEPDKGFDMLDLGANADNKPEHLVQYAVLGSFYAEKVRNVQNPRVGLLNNGTEETKGSELTKKAFELLAADETINFVGNVEARELLNGVADVVVTDGFTGNAVLKSIEGTAMNMMSLLKTAILSEGVKGKMGALLLKNALHGMKDEMDYSKHGGAVLFGLKAPVIKTHGATGPDAVRYTIRQIHTMLETQVVPQLVEYYEGKAE

SEQ ID NO: 3154 - protein, 313 aa, Enterococcus faecalis
MIVTVTMNPSIDISYLLDHLKLDTVNRTSQVTKTPGGKGLNVTRVIHDLGGDVIATGVLGGFHGAFIANELKKANIPQAFTSIKEETRDSIAILHEGNQTEILEAGPTVSPEEISNFLENFDQLIKQAEIVTISGSLAKGLPSDFYQELVQKAHAQEVKVLLDTSGDSLRQVLQGPWKPYLIKPNLEELEGLLGQDFSENPLAAVQTALTKPMFAGIEWIVISLGKDGAIAKHHDQFYRVKIPTIQAKNPVGSGDATIAGLAYGLAKDAPAAELLKWGMAAGMANAQERMTGHVDVENVKKHLMNIQVVEIAK

SEQ ID NO: 3155 - protein, 273 aa, Enterococcus faecalis
MSNQEAIGLIDSGVGGLTVLKEALKQLPNERLIYLGDTARCPYGPRPAEQVVQFTWEMADFLLKKRIKMLVIACNTATAVALEEIKAALPIPVVGVILPGARAAVKVTKNNKIGVIGTLGTIKSASYEIAIKSKAPTIEVTSLDCPKFVPIVESNQYRSSVAKKIVAETLQALQLKGLDTLILGCTHYPLLRPVIQNVMGSHVTLIDSGAETVGEVSMLLDYFDIAHTPEAPTQPHEFYTTGSAKMFEEIASSWLGIENLKAQQIHLGGNEND

SEQ ID NO: 3156 - protein, 81 aa, Coxiella burnetii
NYPFPETLKAYCDLKASLEGVTDILIVVPSFAFHEVITRMKPLIDAKTRIAWGTKGLAKGSRLLHEVVATELGQVPMAVIS

SEQ ID NO: 3157 - protein, 76 aa, Coxiella burnetii
YPFPETLKAYCDLKASLEGVTDILIVVPSFAFHEVITRMKPLIDAKTRIAWGTKGLAKGSRLLHEVVATELGQVPM

SEQ ID NO: 3158 - protein, 524 aa, Coxiella burnetii
MLKDIHQHRILILDFGSQYAQLIARRVREIGVYCELMPCDIDEETIRDFNPHGIILSGGPETVTLSHTLRAPAFIFEIGCPVLGICYGMQTMAYQLGGKVNRTAKAEFGHAQLRVLNPAFLFDGIEDQVSPQGEPLLDVWMSHGDIVSELPPGFEATACTDNSPLAAMADFKRRFFGLQFHPEVTHTPQGHRILAHFVIHICQCIPNWTTKHIIEDSIRDIQEKVGKEQVIVGLSGGVDSAVTATLVHKAIGDQLVCVLVDTGLLRLNEVDEVLNVFQKHLGAKVICVDAKDRFMKALKGISDPEEKRKIAGEQFIRVFEEQAKKLNVKWLGQGTIYPDVIESAKTKTGKGHIIKTHHNVGGLPLNMELKLIEPLRELFKDEVRKLGLELGLPADLIYRHPFPGPGLAIRILGEVSAEYINILKQADAIFIEELKKSDYYHQVSQAFAVFMPLKSVGVKGDARHYGYIIALRAVKTVDFMTAQWADLPHEFLSKVSHRIVNEIKEVSRVVYDMTNKPPATIEWE

SEQ ID NO: 3159 - protein, 382 aa, Shigella flexneri
MKALHFGAGNIGRGFIGKLLADAGIQLTFADVNQVVLDALNARHSYQVHVVGETEQVDTVSGVNAVSSIGDDVVDLIAQVDLVTTAVGPVVLERIAPAIAKGLVKRKEQGNESPLNIIACENMVRGTTQLKGHVMNALPEDAKAWVEEHVGFVDSAVDRIVPPSASATNDPLEVTVETFSEWIVDKTQFKGALPNIPGMELTDNLMAFVERKLFTLNTGHAITAYLGKLAGHQTIRDAILDEKIRAVVKGAMEESGAVLIKRYGFDADKHAAYIQKILGRFENPYLKDDVERVGRQPLRKLSAGDRLIKPLLGTLEYSLPHKNLIQGIAGAMHFRSEDDPQAQELAALIADKGPQAALAQISGLDANSEVVSEAVTAYKAMQ

SEQ ID NO: 3160 - protein, 228 aa, Staphylococcus aureus; identical to SEQ ID NO: 2116

SEQ ID NO: 3161 - protein, 361 aa, Oryza sativa
MKALILVGGFGTRLRPLTLSVPKPLVDFGNKPMILHQIEALKEVGVTEVVLAINYQPEVMLNFLKDFESKLGIKITCSQETEPLGTAGPLALARDKLADGSGDPFFVLNSDVISEYPFAELIQFHKSHGGEATIMVTKVDEPSKYGVVVMEDETDKVERFVEKPKVFVGNKINAGIYLLNPSVLDRIELKPTSIEKEVFPRIAADNGLFAMVLPGFWMDIGQPRDYITGLRLYLDSLRKKAPAKLASGAHVLGNVLVHETAVIGEGCLIGPDVAVGPGCVVEAGVRLSRCTVMRGARVKKHACISSSIIGWHSTVGMWARVENMTILGEDVHVCDEVYSNGGVVLPHKEIKSSILKPEIVM

SEQ ID NO: 3162 - protein, 417 aa, Solanum lycopersicum
MLRKLANQSLSVAGKWQQQQLRRLNIHEYQGAELMSKYGINVPKGVAVASLDEVKKAIQDVFPNQSEVVVKSQVLAGGRGLGTFKNGFQGGVHIVKADQAEDIASKMLGQILVTKQTGAQGKVVSKVYLCEKMSLVNEMYFSIILDRATAGPLIIACRKGGTSIEDLAEKFPDMIIKVPIDVFKGISDADAAKVVDGLAPKVADRNDSIEQVKKLYKLFCETDCTMLEINPLAETSDNKLVAADAKLNFDDNAAYRQKEIFSLRDSSQEDPREVAAAKADLNYIGLDGEIGCMVNGAGLAMATMDIIKLHGGTPANFLDVGGNATEGQVVEAFKILTADEKVKAILVNIFGGIMKCDVIASGIVNAAKQVQLKVPVIVRLEGTNVEQGKRILKESGMKLITAEDLDDAAEKAVKALA

SEQ ID NO: 3163 - protein, 133 aa, Arabidopsis thaliana
KLHRVKRSGMKPLAFLELVVFMAILGALIVSLTIDVVNKHTIWGLEFWKWCVLVMVTLSGMLVTNWFMHFVVFIIEKNYLLRKKVLYFVHGLKKNVQVFIWFSLVLIAWICLFDGDVKRTRKTKRFLDFITWT

SEQ ID NO: 3164 - protein, 132 aa, Arabidopsis thaliana
VAKPNHNYIEEDDLLRFMIKEEVDLVLPLIEDADTGKITRKTFTEWVVNVYTSRKTIGHSLNDTKTAVKQLDKLITGILTVITFIVWMVLLDIASTKLLLVFSSQFLGLAFMIGSTCKNIFESFMFVFVMHP

SEQ ID NO: 3165 - protein, 360 aa, Triticum aestivum
MGSTAADMAASADEEACMYALQLVSSSILPMTLKNAIELGLLETLVAAGGKLLTPAEVAAKLPSTANPAAADMVDRMLRLLASYNVVSCTMEEGKDGRLSRRYRAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVDVGGGVGATVGAITAAYPAIKGINFDLPHVISEAQPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 3166 - protein, 78 aa, Arabidopsis thaliana
LRCSWLKRKSKVTEVDVRIIDDEVTIKLVQKKKINCLLFTTKVLDQLQLDLHHVAGGQIGEHYSFLFNTKICEGSCVY

SEQ ID NO: 3167 - protein, 102 aa, Arabidopsis thaliana
LRCSWLKRKSKVTEVDVRIIDDEVTIKLVQKKKINCLLFTTKVLDQLQLDLHHVAGGQIGEHYSFLFNTKICEGSCVYASGIADTLMEVVEKQYMEAVPSNG

SEQ ID NO: 3168 - protein, 99 aa, Arabidopsis thaliana
LNTLSKDMSFTRKHIDKEEAKKKQSKEFHVVMMLDFRVSLFSLNLLNPNPIERLGQLVSLDGGAQVDISNIFHCEGFLLCTTKDISRVVVWNPCVGQTI

SEQ ID NO: 3169 - protein, 97 aa, Arabidopsis thaliana
TLSKDMSFTRKHIDKEEAKKKQSKEFHVVMMLDFRVSLFSLNLLNPNPIERLGQLVSLDGGAQVDISNIFHCEGFLLCTTKDISRVVVWNPCVGQTI

SEQ ID NO: 3170 - protein, 128 aa, Arabidopsis thaliana
HNVTDKSKVTTKHTFAAMSFLAEIFIFLYVGMDALDIEKWDVVRNSPGQSIGVSSILLGLILLGRAAFVFPLSFLSNLTKSSPDEKIDLKKQVTIWWAGLMRGAVSMALAYNQFTTSGHTKVLGNAIM

SEQ ID NO: 3171 - protein, 69 aa, Arabidopsis thaliana
KIDLKKQVTIWWAGLMRGAVSMALAYNQFTTSGHTKVLGNAIMITSTITVVLFSTVVFGLLTKPLVKHL

SEQ ID NO: 3172 - protein, 127 aa, Oryza sativa
DDPGEADFVGILSIILWTFTMICLVKYVFIVLKADDHGEGGTFALYSLLRQHVNFKGNMPVPVTHLASDINLKFHSKKRILTSKLLKFLEQSTKWQAVITYIVLAGTCMVLGDGALTPAISVLSAVQ

SEQ ID NO: 3173 - protein, 59 aa, Oryza sativa
VNFKGNMPVPVTHLASDINLKFHSKKRILTSKLLKFLEQSTKWQAVITYIVLAGTCMVL

SEQ ID NO: 3174 - protein, 232 aa, Nicotiana tabacum
MGCLSVVGASPCVSSSALSSPTSRLSCAPSCKLILNPIKKNHHLAAFQPAVHLFASNQSRSHASKRNHTTRIFLPHLVASMEEVEETYIMIKPDGVQRGLVGEIISRFEKKGFKLTGLKLFHCPKELAEEHYKDLQSKPFFPKLIDYITSGPVVCMAWEGVGVVASARKLIGATNPLNAEPGTIRGDLAVQTGRNVVHGSDSPDNGKREIALWFGEGELCSWTPVQEPWLIE

SEQ ID NO: 3175 - protein, 136 aa, Camelus bactrianus
MALWLTVVIAFTCIGGLASPVPTPSPKALKELIEELVNITQNQKAPLCNGSMVWSINLTTSMYCAARESLINITNCSVIQRTQRMLNALCPHKLSAKVSSEHVRDTKIEVTQFIKTLLQHSRNVFHYRSFNWSKKS

SEQ ID NO: 3176 - protein, 136 aa, Lama glama; identical to SEQ ID NO: 3175

SEQ ID NO: 3177 - protein, 439 aa, Rhodotorula rubra
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 3178 - protein, 528 aa, Vibrio parahaemolyticus
MPISLGNAFIKNFLGKAPDWYKVAIIAFLIINPIVFFLINPFVAGWLLVAEFIFTLAMALKCYPLQPGGLLAIEAIAIGMTSPAQVKHELVANIEVLLLLVFMVAGIYFMKQLLLFIFTKILLGIRSKTLLSLAFCFAAAFLSAFLDALTVIAVVISVAVGFYSIYHKVASGNPIGDHDHTQDDTITELTRDDLENYRAFLRSLLMHAGVGTALGGVTTMVGEPQNLIIADQAGWLFGEFLIRMSPVTLPVFICGLITCALVEKLKVFGYGAKLPDNVRQILVDFDREERKTRTNQDVAKLWVQGIIAVWLIVALALHLAAVGLIGLSVIILATSFTGVIEEHSMGKAFEEALPFTALLAVFFSIVAVIIDQELFKPVIDAVLAVEDKGTQLALFYVANGLLSMVSDNVFVGTVYINEVKSALMEGLITREQFDLLAVAINTGTNLPSVATPNGQAAFLFLLTSALAPLIRLSYGRMVVMALPYTVVLAIVGLMGIMFFLEPATASFYDAGWIAPHTGDLTPVVSGGH

SEQ ID NO: 3179 - protein, 344 aa, Vibrio parahaemolyticus
MIEIKNVNKVFYQGSKEILALKDINLHIAKGTIFGVIGSSGAGKSTLIRCVNMLEAPSSGSIIVDGVDLTTLSKKQLVETRRNIGMIFQHFNLLSSRTVFDNVALPLELAGKDKSQITTKVTELLKLVGLADKHESYPSNLSGGQKQRVAIARALASDPSVLLCDEATSALDPATTQSILELLKEINRKLNITILLITHEMEVVKSICHEVAIIGGGELVEKGTVGDIFAHPKTELAHEFIRSTLDLSIPEDYQARLQPNRVEGSYPLVRMEFTGATVDAPLMSQISRKYNIDVSILSSDLDYAGGVKFGMMVAELFGNEQDDSAAIEYLREHNVKVEVLGYVL

SEQ ID NO: 3180 - protein, 388 aa, Pseudomonas syringae
MNLHEYQGKQLFAEYGLPVSKGYAVDTPEAAAEACDKIGGTEWVVKAQVHAGGRGKAGGVKLVRSKEDAAAFAQQWLGKRLVTYQTDANGQPVTKILVESCTDIAKELYLGAVVDRSSRRIVFMASTEGGVDIEKIAHDTPEKILKATIDPLVGAQPFQGRDLAFQLGLEGKQVTQFAKIFTGLAKLFQDHDLALLEVNPLVIKADGDLHCLDAKINIDANAMYRQPKLKGFHDPSQDDPREAHAAKFELNYVALEGNIGCMVNGAGLAMGTMDIVNLHGGKPANFLDVGGGATKERVTEAFKIILSDTNVAAVLVNIFGGIVRCDMIAEGIIGAVKEVGVKIPVVVRLEGNNAELGAKVLAESGLNIIAATSLTDAAQQVVKAAEGK

SEQ ID NO: 3181 - protein, 189 aa, Pseudomonas syringae
MEALHKKIREEGIVLSDQVLKVDAFLNHQIDPALMKAIGDEFARLFADAGVTKIVTIEASGIAPAVMAGLNMGVPVIFARKHQSLTLTENLLSATVYSFTKQVESTVAISPRHLNSTDNVLIIDDFLANGKASQALISIIKQAGATVAGLGIVIEKSFQGGRAELDAQGYRVESLARVESLAGGVVTFK

SEQ ID NO: 3182 - protein, 1302 aa, Danio rerio
MTPLKTSVKAFFTLHVLFSCISHGLVEGSRLPDPQLLPDGDTHLQHVGGTLTLICRGSTALHWRLASRNVSSVRIESCEERLHKHCSKLVIHNLRHNDTGIYSCSHKKSSDHEVSTYVFVKDPHHPFVEAYSLPHPLFAYRNDPYFVVPCRTTYPNQNVILETQMNPMADDVKRGVQWDPKKGFTVPLKPYDSYHLITCLTRVDNAEFSSVYLLKRLTMEIKNLAIEPERPRVLVGDTLILNCSAETTYNGRIHFEWEFHKERINRTHHFSTTPVQLAQIMVMSKALIVPNVTMEDKGTYTCTGSIEFKKLQMSTKVIVYEHPFLNVTHNKRKFTSTVEGRRVQFEPRVNAVPAPDRVLWYKDGVAISENSTCYETAGYNLTIKQVRQKDAGIFTIALSNQERGLYRNISYKLEVRVKPKIFEEDVAPAGPQTFRYDQRHKLTCTAFGIPMPNITWFWQPCDPSANLTECKLYTDPLPIENVDDHFPQNPIKDVNSKVGLLKSKNRTISTLVVKTANVSGVYSCTARNELGNRTMRIPFYVDDHPQPFEIEPSTAVAGDDITLTCRGTRYLYDRLTWYDPLGHKVPKDETTLRIEPYTISLSIKLPNVSRNHTLGYECQALKINTNKVVNVTSALTIDERQGPWLMQNLTNQDVNSSSTLTLACLAYGVPAPFITWYKDKTPVTEGPGITLKDDGTLIIERVKKDDEGIYECRASNDGGEAKTSAVITVVGEDGKPNIEVIILVSTGAAATFLWIMLILFIRKLRKPSSADLKTGYLSIIMDPEQMPLDEQCDRLPYDSNKWEFPQDRLRLGKTLGHGAFGKVVEASAFGIDKISTCKTVAVKMLKVGATNNEWRALMSELKILIHIGHHLNVVNLLGACTKRGGPLMIIVEFCKYGNLSNYLRSKRGDFVVYKSQDGKAVRSSSGCDLSELIKRRLESVASTGSSASSGFIEDKSYCDSEEEEEEQEDLYKKVLTLEDLICYSFQVAKGMEFLASRKCIHRDLAARNILLSENNVVKICDFGLARDVYKDPDYVRKGDARLPLKWMAPEAIFDKIYTTQSDVWSFGVLMWEIFSLGASPYPGLHIDEEFCCRLKEGTRMKAPEYSSSEIYQTMLDCWHGEPSQRPTFTELVERLGDLLQASVQQEGKHYIPINTALLTKADPSNQSPTEETSTRPVSLRDSGTAWNIKIRPESVKTFDEVILENGTNKIHEGGQSDSGIGLSSDDLKTLKRLESLARPRSFMSRAMKRKSKESVLLEGEMDKYPPLVPSLSLEDSSLDSEMECHSPPPDYNYVVRYSTPPV

SEQ ID NO: 3183 - protein, 99 aa, Danio rerio
LPYDSNKWEFPQDRLRLGKTLGHGAFGKVVEASAFGIDKISTCKTVAVKMLKVGATNNEWRALMSELKILIHIGHHLNVVNLLGACTKRGGPLMIIVEF

SEQ ID NO: 3184 - protein, 90 aa, Danio rerio
TLGHGAFGKVVEASAFGIDKISTCKTVAVKMLKVGATNNEWRALMSELKILIHIGHHLNVVNLLGACTKRGGPLMIIVEFCKYGNLSNYL

SEQ ID NO: 3185 - protein, 399 aa, Mus musculus
MAHITINQYLQQVYEAIDTRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRIFANNADQQLVKKGKSKVGDMLEKAAELLMSCFRVCASDTRAGIEDSKKWGMLFLVNQLFKIYFKINKLHLCKPLIRAIDSSNLKDDYSTAQRITYKYYVGRKAMFDSDFKQAEEYLSFAFEHCHRSSQKNKRMILIYLLPVKMLLGHMPTIELLRKYHLMQFSEVTKAVSEGNLLLLNEALAKHETFFIRCGIFLILEKLKIITYRNLFKKVYLLLKTHQLSLDAFLVALKFMHVEDVDIDEVQCILANLIYMGHIKGYISHQHQKLVVSKQNPFPPLSTVC

SEQ ID NO: 3186 - protein, 75 aa, Mus musculus
YCQAFKETGNKEGTHSSTFWVLLSIFLGAVAMLCKEQGITVLGLNAVFDILVIGKLDILAAVRKVLHKDKSQENA

SEQ ID NO: 3187 - protein, 67 aa, Mus musculus
CQAFKETGNKEGTHSSTFWVLLSIFLGAVAMLCKEQGITVLGLNAVFDILVIGKLDILAAVRKVLHK

SEQ ID NO: 3188 - protein, 75 aa, Mus musculus; identical to SEQ ID NO: 3186

SEQ ID NO: 3189 - protein, 67 aa, Mus musculus; identical to SEQ ID NO: 3187

SEQ ID NO: 3190 - protein, 118 aa, Mus musculus
MSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAW

SEQ ID NO: 3191 - protein, 63 aa, Mus musculus
TTLKSTYLKLRFLIDIGVKFVGHGLQKDFRVINLMVPKDQVLDTVYLFHMPRKRMISLRFLAW

SEQ ID NO: 3192 - protein, 63 aa, Mus musculus; identical to SEQ ID NO: 3191

SEQ ID NO: 3193 - protein, 118 aa, Mus musculus; identical to SEQ ID NO: 3190

SEQ ID NO: 3194 - protein, 43 aa, Mus musculus
TLEIKKAFFAMVANGVRAAPLWDSKKQSFVGMLTITDFILVLH

SEQ ID NO: 3195 - protein, 22 aa, Mus musculus
WDSKKQSFVGMLTITDFILVLH

SEQ ID NO: 3196 - protein, 859 aa, Mus musculus
MFTLAEVASLNDIQPTYRILKPWWDVFMDYLAVVMLMVAIFAGTMQLTKDQVVCLPVLPSPANSKAHTPPGNADITTEVPRMETATHQDQNGQTTTNDVAFGTSAVTPDIPLQATHPHAESTLPNQEAKKEKRDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTLIKTAKFIFILCYTANFVNAISFEHVCKPKVEHLTGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHVSRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVAIPPSITHVKNLESLYFSNNKLESLPTAVFSLQKLRCLDVSYNNISTIPIEIGLLQNLQHLHITGNKVDILPKQLFKCVKLRTLNLGQNCIASLPEKISQLTQLTQLELKGNCLDRLPAQLGQCRMLKKSGLVVEDQLFDTLPLEVKEALNQDVNVPFANGI

SEQ ID NO: 3197 - protein, 33 aa, Mus musculus
LALIHTIILMVSSNFWFKYPKTCSKVEHFVSIL

SEQ ID NO: 3198 - protein, 127 aa, Mus musculus
PVIEVPSMTILDKKDGEQAKALFEKVRKFRAHVEDSDLIYKLYVVQTLIKTAKFIFILCYTANFVNAISFEHVCKPKVEHLTGYEVFECTHNMAYMLKKLLISYISIICVYGFICLYTLFWLFRIPL

SEQ ID NO: 3199 - protein, 155 aa, Mus musculus
MTILLSQVSTACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSS

SEQ ID NO: 3200 - protein, 155 aa, Mus musculus; identical to SEQ ID NO: 3199

SEQ ID NO: 3201 - protein, 942 aa, Mus musculus
MSTAEASATTADAAEAGGRTKTGSPRTIPVFGVAIPDGEMQGIFKPMDLNRIIKVLEEEDKDVSEEKQLNYIKKLIHCYQNGFPLRDLAQIFKILSLCAEKIEKQPCFVEPASDIIKLCGLPFLKKKVSDEITYTEDTANSFALLGELMKIPSSALRIQICKCIVDFYHAEPLKKHIPGYQQVSSSYKIKMVEVGGLAKAMVQSALLLENQLVEKLWVLKVLQHLSTSGVNCTLMVKAQAASGICAHLNDPDPSGQLLFRSSEVLWNLLEKSSKEEIIQQLSNLECLLALKEVFKNLFVRGHSHYERQLRNDILVITTIIAQNPGAPMIECGFTRDLILFATFNEVKSQNPLVKSLKLFNCYEDFELKKLLFNIIVILCKDLATVQLLIDGKVILALFTYVKKPERLKIMEWSAAQYEELQLHAIATLSSVAPLLIEEYMSCHGNSRILAFLEWCGHEDSYFIHGNSFHGTGGRGNKFAQMRYTLRLLRAMVYLEDETVNKDLCERGVIHQLIEIFKTMMSRPAEKEEAIALEIQSDTLLILSGLCENYIQRKEMFGTEGVDIVLHVMKTDPKNLQRGLGYNVLLFSTLDSIWCCILGCYDSEDYFLEKEGIFLLLDILALNQKKFCNLILGIMVEFCDNPKTSAHVNAWRGKKDLTAASLLIKLWRKEEKELGVKRDRNGKIVDTKRPLFTSFQEEQKTMPLPANCPSIAVMDVAENIRAKIYAVLDKLDFENLPGLSAEDFVTLCIIHRYFDFKIGEIWNEVSEEIKLEKLRLVTTDEKSLNSIIAATENIGKMVASLQSEMIENQALQDVQNEQRVYAKIQATHKQREQANKSWENFLARTSNAKTLKKAKKLQEKAIESSRYTERPQNATFHQTVIKGLNTTVPSGRVVTVQSTPTRLLGGPLADTDIALKKLPIRGGALQRVKVKPPLNDPKKSIPT

SEQ ID NO: 3202 - protein, 610 aa, Mus musculus
MIMFYCLLLPAVPVKSQNPLVKSLKLFNCYEDFELKKLLFNIIVILCKDLATVQLLIDGKVILALFTYVKKPERLKIMEWSAAQYEELQLHAIATLSSVAPLLIEEYMSCHGNSRILAFLEWCGHEDSYFIHGNSFHGTGGRGNKFAQMRYTLRLLRAMVYLEDETVNKDLCERGVIHQLIEIFKTMMSRPAEKEEAIALEIQSDTLLILSGLCENYIQRKEMFGTEGVDIVLHVMKTDPKNLQRGLGYNVLLFSTLDSIWCCILGCYDSEDYFLEKEGIFLLLDILALNQKKFCNLILGIMVEFCDNPKTSAHVNAWRGKKDLTAASLLIKLWRKEEKELGVKRDRNGKIVDTKRPLFTSFQEEQKTMPLPANCPSIAVMDVAENIRAKIYAVLDKLDFENLPGLSAEDFVTLCIIHRYFDFKIGEIWNEVSEEIKLEKLRLVTTDEKSLNSIIAATENIGKMVASLQSEMIENQALQDVQNEQRVYAKIQATHKQREQANKSWENFLARTSNAKTLKKAKKLQEKAIESSRYTERPQNATFHQTVIKGLNTTVPSGRVVTVQSTPTRLLGGPLADTDIALKKLPIRGGALQRVKVKPPLNDPKKSIPT

SEQ ID NO: 3203 - protein, 852 aa, Mus musculus
MSTAEASATTADAAEAGGRTKTGSPRTIPVFGVAIPDGEMQGIFKPMDLNRIIKVLEEEDKDVSEEKQLNYIKKLIHCYQNGFPLRDLAQIFKILSLCAEKIEKQPCFVEPASDIIKLCGLPFLKKKVSDEITYTEDTANSFALLGELMKIPSSALRIQICKCIVDFYHAEPLKKHIPGYQQVSSSYKIKMVEVGGLAKAMVQSALLLENQLVEKLWVLKVLQHLSTSGVNCTLMVKAQAASGICAHLNDPDPSGQLLFRSSEVLWNLLEKSSKEEIIQQLSNLECLLALKEVFKNLFVRGHSHYERQLRNDILVITTIIAQNPGAPMILLIDGKVILALFTYVKKPERLKIMEWSAAQYEELQLHAIATLSSVAPLLIEEYMSCHGNSRILAFLEWCGHEDSYFIHGNSFHGTGGRGNKFAQMRYTLRLLRAMVYLEDETVNKDLCERGVIHQLIEIFKTMMSRPAEKEEAIALEIQSDTLLILSGLCENYIQRKEMFGTEGVDIVLHVMKTDPKNLQRGLGYNVLLFSTLDSIWCCILGCYDSEDYFLEKEGIFLLLDKLAKDLTAASLLIKLWRKEEKELGVKRDRNGKIVDTKRPLFTSFQEEQKTMPLPANCPSIAVMDVAENIRAKIYAVLDKLDFENLPGLSAEDFVTLCIIHRYFDFKIGEIWNEVSEEIKLEKLRLVTTDEKSLNSIIAATENIGKMVASLQSEMIENQALQDVQNEQRVYAKIQATHKQREQANKSWENFLARTSNAKTLKKAKKLQEKAIESSRYTERPQNATFHQTVIKGLNTTVPSGRVVTVQSTPTRLLGGPLADTDIALKKLPIRGGALQRVKVKPPLNDPKKSIPT

SEQ ID NO: 3204 - protein, 627 aa, Mus musculus
MSTAEASATTADAAEAGGRTKTGSPRTIPVFGVAIPDGEMQGIFKPMDLNRIIKVLEEEDKDVSEEKQLNYIKKLIHCYQNGFPLRDLAQIFKILSLCAEKIEKQPCFVEPASDIIKLCGLPFLKKKVSDEITYTEDTANSFALLGELMKIPSSALRIQICKCIVDFYHAEPLKKHIPGYQQVSSSYKIKMVEVGGLAKAMVQSALLLENQLVEKLWVLKVLQHLSTSGVNCTLMVKAQAASGICAHLNDPDPSGQLLFRSSEVLWNLLEKSSKEEIIQQLSNLECLLALKEVFKNLFVRGHSHYERQLRNDILVITTIIAQNPGAPMIECGFTRDLILFATFNEVKSQNPLVKSLKLFNCYEDFELKKLLFNIIVILCKDLATVQLLIDGKVILALFTYVKKPERLKIMEWSAAQYEELQLHAIATLSSVAPLLIEEYMSCHGNSRILAFLEWCGHEDSYFIHGNSFHGTGGRGNKFAQMRYTLRLLRAMVYLEDETVNKDLCERGVIHQLIEIFKTMMSRPAEKEEAIALEIQSDTLLILSGLCENYIQRKEMFGTEGVDIVLHVMKTDPKNLQRGLGYNVLLFSTLDSIWCCILGCYDSEDYFLEKEGIFLLLDILAVSNIHLL

SEQ ID NO: 3205 - protein, 676 aa, Mus musculus
MAAHHRQNTAGRRKVQVSYVIRDEVEKYNRNGVNALQLDPALNRLFTAGRDSIIRIWSVNQHKQDPYIASMEHHTDWVNDVVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLHRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVTPMDEEENEVNHVSGGQESRVQKGNGYFQVPPHTPVIFGEAGGRTLFRLLCRDSGGETEAMLLNETVPQWVIDITVDKNMPKFNKIPFYLQPHASSGAKTLKKDRLSASDMLQVRKVMEHVYEKIINLDNESQTTSSSNNEKPEQEKEEDIAVLAEEKIELLCQDQVLDPNMDLRTVKHFIWKSGGDLTLHYRQKST

SEQ ID NO: 3206 - protein, 662 aa, Mus musculus
MAAHHRQNTAGRRKVQVSYVIRDEVEKYNRNGVNALQLDPALNRLFTAGRDSIIRIWSVNQHKQDPYIASMEHHTDWVNDVVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLHRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMMLTITLDESDCFAAWVSAKDAGFSSPDGSDPKLNLGGLLLQALLEYWPRTHVTPMDEEENEVNHVSGGQESRVQKGNGYFQVPPHTPVIFGEAGGRTLFRLLCRDSGGETEAMLLNETVPQWVIDITVDKNMPKFNKIPFYLQPHASSGAKTLKKDRLSASDMLQVRKVMEHVYEKIINLDNESQTTSSSNNEKPEQEKEEDIAVLAEEKIELLCQDQVLDPNMDLRTVKHFIWKSGGDLTLHYRQKST

SEQ ID NO: 3207 - protein, 199 aa, Mus musculus
MGLVMKVRIPTCHDKPGTTQMVQLTQQADTHTSIILPTVHEVDLFRCFCPVFLHSQMLWELVLLGEPLVVMAPSPSESSETVLALVNCISPLKYFSDFRPYFTIHDSEFKEYTTRTQAPPSVILGVTNPFFAKTLQHWPHIIRIGDLKPAGEIPKQVKVKKLKNLKTLDSKPGVYTSYKPYLNRDEEIIKQLQKGIQQK

SEQ ID NO: 3208 - protein, 942 aa, Mus musculus
MGLTKQYLRYVASAVFGLIGSQKGNIVFVTLRGEKGRYVAVPACEHVFIWDLRKGEKILILQGNKQEVTCLCPSPDGLHLAVGYEDGAIRIFSLLSGEGNITFNGHKAAVTSLKYDQLGGRLASGSKDTDVIIWDVINESGLYRLKGHKDAVTQALFLRERNLLVTSGKDTMVKWWDLDNQHCFKTMVGHRTEVWGLVLVSEEKRLITGAADSELRAWDIDYLQEIDDPEEPEPKKIKECPGIQDTPESEDSTLEADDEKSEDRILSCSKAGSIMREGRDRVVNLAVDKTGRILACHGTDSVLEVFCILSKAEVQKKMDKKLKKARKKARLNSANEEEDPETSVSMTLQDEILRVAKIKTSAKIKSFDLIHSPQGELKAVFLLQNNLVELYSLNASLPAPQPVRTSRITIGGHRSDVRTLSFSSDNIAVLSAAADSIKIWNRSTLQCIRTMPCEYALCSFFVPGDRQVVIGTKTGNLQLYDLASGTLLETIAAHDGALWSMSLSPDQRGFVTGGADKAVKFWDFELVTDKNSTQKRLSVKQTRTLQLDEDVLCVSYSPNQKLLAVSLLDCTVKVFYVDTLKFFLSLYGHKLPVLCMDISHDGALIATGSADRNVKIWGLDFGDCHRSLFAHDDSVMYLRFVPKSHLFFTAGKDHKIKQWDADKFEHIQTLEGHHQEIWCLAVSPSGDYVVSASHDKSLRLWERTREPLILEEEREMQREAEYEESVAKEDQPAVPGETQGDNYFTGKKTIETVKAAERIMEAIELHREETAKMKEHRAICKAAGKEVPLPVNPILMAHGNISPSAYVLETFKGIRSSELEEALLVLPFSYVPDVLTLFNEFIQTGLDVELLCRCLFFLLRIHFGQITSNQMLVPVIEKLKETTISKVRQVQDAIGFNMAGLDYLKRECEAKSEVMFFAEATSHLEEKKKKRKNRKRMILTLT

SEQ ID NO: 3209 - protein, 1105 aa, Mus musculus
MAAAGSAGLPATVSEKQEFYQLLKNLINPSCMVRRQAEEVYENIPGLCKTTFLLDAVRNRRAGYEVRQMAAALLRRLLSSGFEEVYPNLPPEVQRDVKIELILAVKLETHASMRKKLCDIFAVLARNLIDESGTNHWPEGLKFLIDSIHSKNVVLWEVALHVFWHFPGIFGNQDRHDLDIIKRLLDQCIQDQEHPAIRTLSARAAATFVLANENNIALFKDFADLLPGILQAVNDSCYQDDDSVLESLVEIADTVPKYLGPYLEDTLQLSLKLCGDSRLSNLQRQLALEVIVTLSETATPMLKKHTNIIAQAVPHILAMMVDLQDDDDWVNADEMEEDDFDSNAVAAESALDRLACGLGGKVVLPMTKEHIMQMLQSPDWKCRHAGLMALSAIGEGCHQQMEPILDETVNSVLLFLQDPHPRVRAAACTTLGQMATDFAPSFQKKFHEIVITALLRTMENQGNQRVQSHAASALVIFIEDCPKSLLILYLENMVKSLHSILVIKLQELIRNGTKLALEQLVTTIASVADAIEESFIPYYDIFMPSLKHVVELAVQKELKLLRGKTIECISHVGLAVGKEKFMQDASNVMQLLLKTQSDLNNMEDDDPQTSYMVSAWARMCKILGKDFEQYLPLVIEPLIKTASAKPDVALLDTQDVENMSDDDGWQFVNLGDQQSFGIKTSGLEAKATACQMLVYYAKELREGFVEYTEQVVKMMVPLLKFYFHDNVRVAAAEAMPFLLECARIRGSEYLSQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCANSKTKKNVIATENCISAIGKILKFKPNCVNVDEVLPHWLSWLPLHEDKEEAIQTLNFLCDLIESNHPVVIGPNNSNLPKIISIIAEGKINETISHEDPCAKRLANVVRQIQTSEELWLECTSQLDDEQQEALHELLSFA

SEQ ID NO: 3210 - protein, 164 aa, Mus musculus
ATVKQLKEFIQQPENKLVLVKQLDNILAAVHDVLNESSKLLQELRQEGACCLGLLCASLSYEAEKIFKWIFSKFSSSAKDEVKLLYLCATYRALETVGEKKAFSSVMQLVMTSLQSILENVDTPELLCKCVKCILLVARCYPHIFSTNFRDTVDILVGWHIDHT

SEQ ID NO: 3211 - protein, 96 aa, Mus musculus
KWIFSKFSSSAKDEVKLLYLCATYRALETVGEKKAFSSVMQLVMTSLQSILENVDTPELLCKCVKCILLVARCYPHIFSTNFRDTVDILVGWHIDH

SEQ ID NO: 3212 - protein, 125 aa, Mus musculus
HYPTHVKVTTQDLIGNRNMQMMSIEILTLLFTELAKVIESSAKGFPSFISDMLSKCKVQKVILHCLLSSIFSVQKWHSEKTAGKSMVAVEEGFSEDSLINFSEDELDNGSTLQSQLLRVLQRLIV

SEQ ID NO: 3213 - protein, 62 aa, Mus musculus
TLLFTELAKVIESSAKGFPSFISDMLSKCKVQKVILHCLLSSIFSVQKWHSEKTAGKSMVAV

SEQ ID NO: 3214 - protein, 125 aa, Mus musculus; identical to SEQ ID NO: 3212

SEQ ID NO: 3215 - protein, 62 aa, Mus musculus; identical to SEQ ID NO: 3213

SEQ ID NO: 3216 - protein, 82 aa, Mus musculus
ENKLKIPIGAKIQTLHLVGVNVPEIPCIPMLRHLYMKWVRLTKPQPFKDFLCISLRTFVMRNCAGPTNSLKYVPLVTGLASA

SEQ ID NO: 3217 - protein, 72 aa, Mus musculus
KIPIGAKIQTLHLVGVNVPEIPCIPMLRHLYMKWVRLTKPQPFKDFLCISLRTFVMRNCAGPTNSLKYVPLV

SEQ ID NO: 3218 - protein, 56 aa, Mus musculus
IHLQDLSGKTIAVDLSLWVCEAQTVKKMIGTVKKPHLRNLFFRISYLTQMNVKLVF

SEQ ID NO: 3219 - protein, 71 aa, Mus musculus
IHLQDLSGKTIAVDLSLWVCEAQTVKKMIGTVKKPHLRNLFFRISYLTQMNVKLVFVMEGEPPMLKADVIS

SEQ ID NO: 3220 - protein, 115 aa, Mus musculus
KILPVNLKAVKGYFTLRQPVVLWKEMDKLPVHSIKCVPLYHPYQKCSCSLVVAARGSYVFWCLLLISKAGLNVHNSHVTGLHSLPIVSITADKQNGTVYTCSSDGKVRQLIPIFT

SEQ ID NO: 3221 - protein, 74 aa, Mus musculus
AVSPCGAYLAIITTEGMMNGLHPVNKNYQVQFVTLKTFEEAAAQLLESSVQNLFKQVDLIDLVRWKILKDKHIP

SEQ ID NO: 3222 - protein, 494 aa, Mus musculus
MSGLIVGSAFGPVKILPVNLKAVKGYFTLRQPVVLWKEMDKLPVHSIKCVPLYHPYQKCSCSLVVAARGSYVFWCLLLISKAGLNVHNSHVTGLHSLPIVSITADKQNGTVYTCSSDGKVRQLIPIFTDVALKFEHQLIKLSDVFGSVRTHGIAVSPCGAYLAIITTEGMMNGLHPVNKNYQVQFVTLKTFEEAAAQLLESSVQNLFKQVDLIDLVRWKILKDKHIPQFLHEALEKKIESSGVTYFWRFKLFLLRILYQSMQKSPSEALWKPTHEDSKILLVDSPGMGDGEDEQQEEGTSKQGTKAGLQEKSKEGDTEETPEDSLTAGGDTGGREPVEEKLLEIQGKIEAVEMHLTREHMKRVLGEVYLHTWITENTSIPTRGLCNFLMSDEDYDDRTAQVLIGHISKKMNKQTFPERCSLCKEILPFTDRKQAVCSNGHIWLRCFLTYQSCQSLIYRRCLLHDSIARHPVPEDPDWIKRLLQSPCPFCDSPVF

SEQ ID NO: 3223 - protein, 115 aa, Mus musculus; identical to SEQ ID NO: 3220

SEQ ID NO: 3224 - protein, 74 aa, Mus musculus; identical to SEQ ID NO: 3221

SEQ ID NO: 3225 - protein, 35 aa, Mus musculus; identical to SEQ ID NO: 2876

SEQ ID NO: 3226 - protein, 124 aa, Mus musculus
VFLVKTVKAHDGPVFSMHALEKGFVTGGKDGMVALWDDSFERCLKTYAIKRADLAPGSKGLLLEDNPSIRAISLGHGHILVGTKNGEILEVDKSGPITLLVQGHMEGEVWGLATHPYLPICATV

SEQ ID NO: 3227 - protein, 280 aa, Mus musculus
MKFRAKIVDLACLNHFTRVSNMIAKLAKTCTLRISPEKLNFILCDKLASGGVSMWCELEQENFFSEFQMEGVSEENNEIYLELTSENLSRALKTAQNSRALKIKLTNKHFPCLTVSVELVSSSSSSRIVVHDIPIKVLPRRLWKDLQEPSIPDCDVSICLPALKMMKSVVEKMRNISNQLVIEANLKGELNLKIETELVCVTTHFKDLENPLLPSDSVSQNRHPEDMAKVHIDIKKLLQFLAGQQVTPTKAVCNIVNNRTVHFDLLLEDVSLQYFIPALS

SEQ ID NO: 3228 - protein, 281 aa, Mus musculus
MKFRAKIVDLACLNHFTRVSNMIAKLAKTCTLRISPEKLNFILCDKLASGGVSMWCELEQENFFSEFQMEGVSEENNEIYLELTSENLSRALKTAQNSRALKIKLTNKHFPCLTVSVELQVSSSSSSRIVVHDIPIKVLPRRLWKDLQEPSIPDCDVSICLPALKMMKSVVEKMRNISNQLVIEANLKGELNLKIETELVCVTTHFKDLENPLLPSDSVSQNRHPEDMAKVHIDIKKLLQFLAGQQVTPTKAVCNIVNNRTVHFDLLLEDVSLQYFIPALS

SEQ ID NO: 3229 - protein, 920 aa, Mus musculus
MLEGKMADINFKEVTLIVSVVAACYWNSLFCGFVFDDVSAILDNKDLHPSTPLKTLFQNDFWGTPMSEERSHKSYRPLTVLTFRLNYLLSELKPMSYHLLNTVFHAVVSVIFLKVCRLFLDKRSSMIAALLFAVHPIHTEAVTGVVGRAELLSSVFFLAAFLSYTKSKGPDNSIVWTPIVLTVFLVAVATLCKEQGITVVGICCVYEVFVAQGYTLPMLCTVAGQFLRGKGSIPLSMLQTLVKLIVLMLSTLLLVVVRVQVIQSQLPVFTRFDNPAAVSPTPTRQLTFNYLLPVNAWLLLNPSELCCDWTMGTIPLIESFLDVRNLATFAFFCFLGALGIFSLRYPGDSSKTVLMALCLMALPFIPASNLFFPVGFVVAERVLYVPSMGFCILVAHGWQKISNKSVLKKLSWVCLSMVILTHALKTLHRNWDWESEYTLFMSALKVNKNNAKLWNNVGHALENEKNFEKALKYFLQATHVQPDDIGAHMNVGRTYKNLNRSREAEASYMLAKSLMPQIIPGKKYAARIAPNHLNVYINLANLIRANESRLEEADQLYRQAISMRPDFKQAYISRGELLLKMNKPLKAKEAYLKALELDRNNADLWYNLAIVYIELKEPNEALKNFNRALELNPKHKLALFNSAILMQESGEVKLRPEARKRLLNYVNEEPQDANGYFNLGMLAMDDKKDSEAESWMKKAIKLQPDFRSALFNLALLYSQTAKELKALPILEELLKYYPDHTKGLILKGDILMNQKKDIPGAKKCFEKILEMDPSNVQGKHNLCVVYFEEKELLKAERCLVETLALAPHEEYIQRHLSIVRDRISSSGIVEQPLAPADKTPGTEEREEIPSEDVKEISSESRPPQILKTNNNRNSKSNKQSTENADQDAPHKTTKDIKEIEKKRVAALKRLEEIERILNGE

SEQ ID NO: 3230 - protein, 658 aa, Mus musculus
MLEGKMADINFKEVTLIVSVVAACYWNSLFCGFVFDDVSAILDNKDLHPSTPLKTLFQNDFWGTPMSEERSHKSYRPLTVLTFRLNYLLSELKPMSYHLLNTVFHAVVSVIFLKVCRLFLDKRSSMIAALLFAVHPIHTEAVTGVVGRAELLSSVFFLAAFLSYTKSKGPDNSIVWTPIVLTVFLVAVATLCKEQGITVVGICCVYEVFVAQGYTLPMLCTVAGQFLRGKGSIPLSMLQTLVKLIVLMLSTLLLVVVRVQVIQSQLPVFTRFDNPAAVSPTPTRQLTFNYLLPVNAWLLLNPSELCCDWTMGTIPLIESFLDVRNLATFAFFCFLGALGIFSLRYPGDSSKTVLMALCLMALPFIPASNLFFPVGFVVAERVLYVPSMGFCILVAHGWQKISNKSVLKKLSWVCLSMVILTHALKTLHRNWDWESEYTLFMSALKVNKNNAKLWNNVGHALENEKNFEKALKYFLQATHVQPDDIGAHMNVGRTYKNLNRSREAEASYMLAKSLMPQIIPGKKYAARIAPNHLNVYINLANLIRANESRLEEADQLYRQAISMRPDFKQAYISRGELLLKMNKPLKAKEAYLKALELDRNNADLWYNLAIVYIELKEPNEALKNFNRALELNPKHKLALFNSAILMQESGKFPENVSI

SEQ ID NO: 3231 - protein, 600 aa, Mus musculus
MEPRGAEYFCAQVLQKDVSGRLQAGEELLLCLGTPGAIPDLEDDPSRLAKTVDALTRWVGSSNYRVSLLGLEILSAFVDRLSTRFKSYVTMVTTALIDRMGDVKDKVREEAQNLTLKLMDEVAPPMYIWEQLASGFKHKNFRSREGVCLCLIETLNIFGTQPLVISKLVPHLCVLFGDSNSQVRNAALSAVVEIYRHVGEKLRIDLCKRDIPPARLEMVLAKFDEVQNSGGMILSVCKDKSFDDEESVDGNRPSSAASAFKVPAPKTPGNPVSSARKPGSAGGPKVGGPSKEGGAGAVDEDDFIKAFTDVPSVQIYSSRELEETLNKIREILSDDKHDWDQRANALKKIRSLLVAGAAQYDCFFQHLRLLKELSNHNERIEERKIALYELMKLTQEESFSVWDEHFKTILLLLLETLGDKEPTIRALALKVLKEILRHQPARFKNYAELTVMKTLEAHKDPHKEVVRSAEEAASVLATSISPEQCIKVLCPIIQTADYPINLAAIKMQTKVIERVSKETLNMLLPEIMPGLIQGYDNSESSVRKACVFCLVAVHAVIGDELKPHLSQLTGSKMKLLNLYIKRAQTGSAGADPTADVSGQS

SEQ ID NO: 3232 - protein, 509 aa, Mus musculus
MSENLDKSHVDEAGEAEAAASEQGLEGALECSDETLQKKVKSDSPSSQRVGRPHSSPARLVTVEELLETAKGVTNMALAHEIVVTGDFRINAVELAEGSLEKRVKEIVHKAFWDCLSVQLSEEPPTYDHAIKLVGEIKETLLSFLLPGHTRLRNQITEVLDLELIKQEAENGALDISKLAEFIIGMMGILCAPARDEEVKKLKGIKEIVPLFRAIFSVLDLMKVDMANFAISSIRPHLMQQSVEYERRKFQEVLERQPNSLDFATQWLEEATNDLLSQKYKHALPAGGGAAGSGDAPLLTPVSVQNFAYLKLLKWDHFQRPFPETVLMDQSRFQELQLQLEQLAVLGAVLLVTFSTAAPGISGHADFAEKLKMMVKTLLTDMHLPSFHLEDALASIGEKVCLEVSSCLSLCGSSPFSVAKETVLKGQIQALASPEDPIRRIMESRIFTFLETYLASGHQKPLPTVPGGLGPIQKELEEVAVKFVRLVNYNKMVFCPYYDAILSKLLLRS

SEQ ID NO: 3233 - protein, 1034 aa, Mus musculus
MEADGAGEQMRPLLTRGPDEEAVVDLGKTSSTVNTKFEKEELESHRAVYVGVHVPFSKESRRRHKHRGHKHHHRRRKDKDSDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDDSIRENVREALLKRHHHQNEKRFTSRIPLVRSFADIGILASPQSAPGNLDNSKSGEMKGNGSGGSRENSTVDFSKVDMNFMRKIPTGAEASNVLVGEVDFLERPIIAFVRLAPAVLLSGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFPNGSAAMSVGPPKEDDHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILFKFCRDYHLSYLSLRTSIGLWTSFLCIVLVATDASSLVCYITRFTEEAFAALICIIFIYEALEKLFHLGEIYAFNMHNNLDELTSYTCVCAEPSNPSNETLELWKRKNITAYSVSWGNLTVSECKTFHGMFVGSACGPHGPYVPDVLFWCVVLFFTTFFLSSFLKQFKTKGYFPTKVRSTISDFAVFLTIVIMVAIDYLVGIPSPKLHVPEKFEPTDPSRGWIISPLGDNPWWTLLIAAVPALLCTILIFMDQQITAVIINRKEHKLKFIPMPVLYGVFLYMGVSSLKGIQFFDRIKLFGMPAKHQPDLIYLRYVPLWKVHVFTVVQLTCLVLLWVIKASAAAVVFPMMVLALVFVRKLMDLCFTKRELSWLDDLMPESKKKKEDDKKKKEKEEAERMLQDDEDTVHLPFERGSLLQIPVKTLKYSIDPSVVNISDEMAKTAQWKALSMNTENAKVTRPNTSPEKPVSVTINFEDEPSKKYMDAETSL

SEQ ID NO: 3234 - protein, 167 aa, Mus musculus
LKQFKTKGYFPTKVRSTISDFAVFLTIVIMVAIDYLVGIPSPKLHVPEKFEPTDPSRGWIISPLGDNPWWTLLIAAVPALLCTILIFMDQQITAVIINRKEHKLKKGAGYHLDLLMVGVMLGVCSIMGLPWFVAATVLSISHVNSLKVESECSAPGEQPKFLGIREQ

SEQ ID NO: 3235 - protein, 111 aa, Mus musculus
KEHKLKKGAGYHLDLLMVGVMLGVCSIMGLPWFVAATVLSISHVNSLKVESECSAPGEQPKFLGIREQRVTGLMIFILMGLSVFMTSVLKVKPLWQCSTILFTLTFILSCK

SEQ ID NO: 3236 - protein, 1262 aa, Mus musculus
MVQQVPENISFPAEEEKILEFWSKHNCFQECLKQSKLRPKFTFYDGPPFATGLPHYGHILAGTIKDIVTRYAHQSGFHVDRRFGWDCHGLPVEYEIDKTLGIKGPEDVAKMGIAEYNKQCRAIVMRYSAEWKSTVTRLGRWIDFDNDYKTLYPQFMESVWWVFKQLYDKGLVYRGVKVMPFSTACGTPLSNFESNQNYKDVQDPSVFVTFPLEEDENTSLVAWTTTPWTLPSNLALCVNPEIQYVKIKDVARGKLFILTEARLSALYKQESDYEILERFPGASLKGKKYKPLFDYFIKCKENGAFTVLVDHYVKDEEGTGVVHQAPYFGADDHRVCMDFNIIQKDSVPVCPVDASGCFTEEVTHFVGQYVKDADKNIIRMLKEQGRLLAAGTFTHSYPFCWRSDTPLIYKSVPSWFVRVEPMVDQLLKNNDLCYWVPEFVREKRFGNWLKEARDWAISRNRYWGTPIPLWVSEDLEEVVCIGSVAELEELSGTKISDLHRESIDHLTIPSRCGKAPLRRVSEVFDCWFESGSMPYAQVHYPFESKREFEDAFPADFIAEGIDQTRGWFYTLLVLATALFGQPPFKNVIVNGLILASDGQKMSKRKKNYPDPVSIIDKYGADALRLYLINSPVVRAENLRFKEEGVRDVLKDVLLPWYNAYRFFIQNVFRLHKEEEVKFLYNEHTVRESPNITDRWVLSFMQSLLGFFETEMAAYRLYTVVPRLVKFVDILTNWYVRMNRRRLKGESGVEDCVMALETLFSVLLSLCRLMAPYTPFLTELMYQNLKLLIDPASLRDKDTLSIHYLMLPRVREELIDKKTENAVSRMQSVIELGRVIRDRKTIPIKYPLKEIVVIHQDPEALEDIRSLEKYIIEELNVRKVTLSTDKNKYGIRLRAEPDHMVLGKRLKGAFKAVMMAIKRLSNEELERFQKSGSIVVEGHELHEEDIRLMYTFDQATGGTAQFEAHSDAQALVLLDVTPDQSMVDEGMAREVINRIQKLRKKCNLVPTDEITVYYNAKSEGRYLNNVIESHTDFIFATIKAPLKPYPVPTSDNILIQEQTQLKGSELEITLTKGSCVPGPACAYVNLNICANGTEQGGVLLLENPKGDNQLNLVKLKTVVTSVFGVKNAKLSVFHGETEIQNQTDLLSLSGRTLCVTAGASPSPISSPSTLLCQYLNLQLLNAEPQECLTGTVGTLLLENPLGQNGLTHQGLVHEAAKVFGLRSRRLRLFLNETQTQEITEDIPMKTLNMKTVYVSVLPTTADG

SEQ ID NO: 3237 - protein, 449 aa, Mus musculus
MLCSLSLVLCGLLAGTRADPGGLLRLGMDIMNHEVQSAMEESHILEKMAAEASNPQPGGKAIKGLSNMKVKDVLEPVITLNFVPGVGISQCVSTGMTITGKSFTGGNMEINVVLNITATDRLLQDEEAGTPVFRSEGCEVILVSVKTNLPNNKAINKFVDSTLRKVLPGLMCPAIDAVLEYVNKKWAKLTDPMPVDKMGTVKYALTSPPATTASHIQVDFSPVVQLQEGQLIQLATDGSLPEFPEGSAKDSQLLLSATFLTAELALLQKSLEVKLKDKRVGKLPQNTRTLAGFIPQVAKTYHKPKPLLIKVKINKPPKVTMKAGKSLMHLHGSLEMFAARRHGKHPKSLFRLETHIGLEIHYSVQDNRLQMVTSMDSLLSLARESSSVGDFHEAELTGFITDYLQKAYIPVVNDVLHVGLPLPDLLAINYNLAELDIVEDALVLGLKTE

SEQ ID NO: 3238 - protein, 422 aa, Mus musculus
MAMRTRLTWQQEKCLQNYFGGKRFCLLYKASVQKFSHQNLLCTCENQGPTMIVVYSEKCVIGMYLKEGFQGKDVSITIFALQETGFSLCAKGPDSPYLLFHKRKTNDFSILLDEKAVIVSSAICKMLQLTARNNVIPIQECEAFRCEELLDERKTRGIAVLHSNLLQALRDYKPYGDLVQQTRVLLLGPIGAGKSSFVNSVKSVFKGSITHQILVGCDEDGISDKYRTYSIKAKDDSDPLPFILCDSLGLGENAGLHTDDVWHILKGHTPDRYQFDSMKPITSNHPNYTHDPLLKDRIHCVVFVFDINSFEMHSSELVAKIKKIRRDLIKHGILHLALLTHVDSLDLITKEDMTDIYNYSPVKSKLEAFHGVFGFALSDILVVSNYVSEWQLDPVKDMLILSALKEILYTANEFLEDLPLNK

SEQ ID NO: 3239 - protein, 520 aa, Mus musculus
MSNKSDVIVVGGGISGMAAAKLLHDCGLSVVVLEARDRVGGRTYTIRNKNVKYVDLGGSYVGPTQNRILRLAKELGLETYKVNEVERLIHFVKGKSYAFRGPFPPVWNPITYLDNNNLWRTMDEMGQEIPSDAPWKAPLAEEWDYMTMKELLDKICWTKSTKQIATLFVNLCVTAETHEVSALWFLWYVKQCGGTTRIISTTNGGQERKFIGGSGQVSERIKDILGDRVKLERPVIHIDQTGENVIVKTLNHEIYEAKYVISAIPPALGMKIHYSPPLPMLRNQLISRVPLGSVIKCMVYYKEPFWRKKDFCGTMVIEGEEAPIAYTLDDTKPDGTYAAIMGFILAHKARKLVRLTKEERLRKLCELYAKVLNSQEALQPVHYEEKNWCEEQYSGGCYTTYFPPGILTQYGRVLRQPVGKIFFAGTETASHWSGYMEGAVEAGERAAREILHAIGKIPEDEIWQPEPESLDVPARPITSTFLERHLPSVPGLLKLFGLTTILSATALGFLAHKRGLFVHF

SEQ ID NO: 3240 - protein, 36 aa, Mus musculus
ELLDKICWTKSTKQIATLFVNLCVTAETHEVSALWF

SEQ ID NO: 3241 - protein, 33 aa, Mus musculus
KICWTKSTKQIATLFVNLCVTAETHEVSALWFL

SEQ ID NO: 3242 - protein, 534 aa, Mus musculus
MVSEKCVAAFFLLQLCWAGCGFCSKVLVWPCDMSHWLNLKTILEELGARGHEVTVLKYPSIIIDQSKRIPLHFENIPLLYEIETAENRLNEIANLAVNVIPNLSLWEAAKTLQDFFLQVTGDFESICRSVLYNQKFMDKLRDAQYDVVVIDPVVPCGELVAEVLQIPFVYTLRFSMGYYMEKHCGQLPIPLSYVPVVMSELTDNMTFTERVKNMMFSLLFEYWLQQYDFAFWDQFYSETLGRPTTFCKTVGKADIWLIRTYWDVEFPRPYLPNFEFVGGLHCKPAKPLPKEMEEFVQSSGEHGVVVFSLGSMVKNLTEEKANLIASVLAQIPQKVLWRYSGKKPATLGSNTRLFNWIPQNDLLGHPKTKAFITHGGTNGIYEAIYHGVPMVGVPMLGDQPHNIAHMEAKGAALKVSISTMTSTDLLSAVRAVINEPSYKENAMRLSRIHHDQPVKPLDRAVFWIEFVMRHKGAKHLRVAAHDLSWFQYHSLDVIGFLLLCVVTLTFIITKFCLFVCQKLYMKESKKMGNRKKKN

SEQ ID NO: 3243 - protein, 126 aa, Mus musculus
VVVFSLGSMVKNLTEEKANLIASVLAQIPQKVLWRYSGKKPATLGSNTRLFNWIPQNDLLGHPKTKAFITHGGTNGIYEAIYHGVPMVGVPMLGDQPHNIAHMEAKGAALKVSISTMTSTDLLSAV

SEQ ID NO: 3244 - protein, 48 aa, Mus musculus
KGAKHLRVAAHDLSWFQYHSLDVIGFLLLCVVTLTFIITKFCLFVCQK

SEQ ID NO: 3245 - protein, 54 aa, Mus musculus
EAETLTNVLDFKRDAGLWHGVLTSVMNRMHVITIPYALMKVNPLSWIQKVCSYK

SEQ ID NO: 3246 - protein, 50 aa, Mus musculus
LTNVLDFKRDAGLWHGVLTSVMNRMHVITIPYALMKVNPLSWIQKVCSYK

SEQ ID NO: 3247 - protein, 3748 aa, Mus musculus
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAEKEEKSLQDIKQKELCRIEEALQKAAEKGAHSGEFMYGLENLLYKDVKPGRKRKKHKKHFKKRFKGLDRSKDKPKEAKKDTFLEKLATQVIKNVQVKITDIHIKYEDDITDPERPLSFGVTLREFSLLTTNEHWTPCILNEAEKIIYKLVKLDSLSAYWNVGCCMSYRGSREHILEQLKREILTSTNIPPDHQYIFQPISASAKLYMNPGAESELKTPKLDGNVEVQNIAIELTKPQYLSMIDFLESLDYMVRNAPYRKYKPCLPLHTNCRQWWKYAIDSVLEVHIRRYTQPWSWSNIKNHRQLLKSYKMAYKTKLTQAKVSEEIQKQIQDLEKSLDVFNIILVRQQAQVEVIHSGQKLRKKSAEAGEKRGWFSGFWGKKESKKRDEESSVPETIDDLMTPEEKDKLFTAIGYSENAYNLALPKQYVAHILTLKLVSTSIIIRENRNVPEILRVQIIGLGTQVSQRPGAQALKIEAKLEHWYVTGLRQQDIVPSLVASIGDTTSSLLKIEFETNPENSPADQTLIVQSQPVEVIYDAKTINAVVEFFQSNKGLDLEQITSATLMKLEEIKERTATGLTHIIETRKVLDLRINLKPSYLIIPQTGFHHEKSNLLILDFGTFQLNSKDQGAQKTANASLEEIIDKAYDKFDVEIRSVQLLFAKAEENWKKCRFQHPSTMHILQPMDIHVELAKAMVEKDVRMAKFKVSGGLPLMHVRISDQKIKDALCLINSIPLPQKSSTPSPERQVASIPVLSGGTKALLGTSLLLDGVESESDEEFFDAEDGDSQAARTVKASELKKAAEVPNEELVSLLLKFEIKEVVLELTKQQKEEETILVFNVTQLGTEATMRTFDLTAVSYLRKISLDYHDIKGSRKKPIHLISSSDRPGLDLLKVEYIKVDRNGPSFQTTFEKTEQTVKVAFSSLNLLLQTQALLSSLNYLTTVIPSDSQNTGVAKEVQAMPEKQKNSPLQKVMVPSRDSDVIGFRLFAKLNAFCVTVCDEKSNIAEIKIQGLDSSLSLQSKKQSLFARLENIIVTDVDPKTIHKKAVSIVGNEVFRFNLDLYPDATEGDSYTDMSTVDGVVALHVGCIQIVYLHKFLMSLLSFLNNFQVAKEALSAATAQAAEKAATSVKDLAQRSFRVSVDIDLKAPVIVIPQSSLSTNAVVVDLGLIRVHNRFSLVSGEDTANPPVIDKMEVQLTKLKLSRTAIQPGTSHPDIQLLHPINLEFFVSRNLAANWYHKVPVVEIKGRLDSMNVSLNQEDLNLLFRILAENLGEATEDLDKGKPRIQERGETKACREVSTPQDVHTTQGVPAARVEETRPVDIINVLLNFEIKEVVVTLMKKAERKGSPFHELKILHLGMEAKVKAHDMTAAAYLRNISMRCFHFPDSKGEPLRIVNTSDVSDGILLKLLFIKADSDGPDFKTIHDNTKQKLKVSFSSLDLVLHLEALLSLMDFLSSAIPSSDSSSSEKEPELKPLVGESRSLAIRAVPSSYEGDAFDLKITAELNAFNIFICDQKSNIAEIKIHGMDASISVKPKQTDVFARLKNIIVMNVDSLSIHKKAVSILGDEVFRFQMSLYPDATEGENYGDMSKVDGRLSLKVGCIQIVYVHKFFMSLLSFLNNFQAAKEALSTATVQAAERAASSVKDLAQKSFRLLMDIDLKAPVITIPQSSVSPNVVIADLGLIRVENKFSLVSVEQLALPPVADEMSIQLTQLKLARTVLQADSPQHDVEILKPVNMLLCIQRNLSAAWYTQIPGMEIKGELKPMQVALSQDDLTVLMKILLENLGEASSQPSPTQYAQEAARVKRDTRSGPDYLKEQELADPKPPGDQTVTLQFDFHFDSLSIILYNSDSSQEPRLSFHNDSFRLGELTLHLMASAGKMFKDGSMNVSLKLKTCTLDDLREGIERATSRMIDKKNDQDNNSSMIDISYSQDKNGSQVDAVLDKLYVCASVEFLMTVADFFIKAMPQSPENIAKEIQIPSRQTAAGRVKMEKDDSVRPNMTLKAMITDPEVVFVASLTKADAPALTASFQCNLSLSTSKLEQMMEASVRDLKVLACPFLRERRGKSITTVLQPCSLFMEKCTWASGKQNINIVVKEFVIKISPIILNTVMTIMAAMSPKTKEDEWKDTPKETDNLWAVKSITDYNSWFLGVDMATEVTENFRDSEHPSIEENCVVAVESVQVTLECGLGHRTVPLLLAESKFSGNIKNWTSLMAAAADMTLEVHYYNETHAVWEPLIERVEGNKPWSLKLNVKKNPIQDKSLMPGDDFIPEPQTAVHISSGATMNITISKSCLNVFSNLAKGFSEGAASTFDYSLKDRAPFTVKNALGVPMKVQPNRNLKVMGSPEKSDIYDVGAGQHLELDYASLEPSRQGKLSILSRQESSLFTLTFVPYGYTEVASVPVARPGRRLYNVRNPSASHSDSVLVQIDATEGNKVVTLRSPLQIKNHFSIAFIIYKFVKNVKLLERIGIARPEEEFHVPLDSYRCQLYVQPAGGLEQQYTHSSTYISWKEELHRSREVRCMLQCPAVEVSFLPLIVNTVALPDELSYIGAHGEDWDPAYVIHLYPPLTLRNLLPYSLRYLLEGTAETHELAEGSSADVLHSRISGEIIELVLVKYLGKNWNGHFRICDTLPEFFLVCFSSDTAEVMTVDLSVHVRRIGCRMELSVFSPYWLINKTSRVLQYRSEEIHVKHPADFRDIILFSFKKKNIFSKNKVQLKISTSAWSNGFSLDTVGSYGCVKCPATNMEYLVGVSIKMSSFNLSRVVTLTPFCTVANKSSLDLEVGEIASDGSIPTNKWHYVASSECIPFWPENLSGKLCVRVVGYEGSSKPFFYNRQDNGTLLSLEDLNGGILVDINTAEHSTVITFSDYHEGSAPALIMNHTQWDVLTYKQSGSQEELVLLPGETRLFAWADPTGIRKLTWNYAANFGEHDLLKDECGQFPYDANIQIHWVSFLDGRQRVLLFTDDVALVSKALQAEEMEQADHEVALSLHSLGLSLVNNENKQEVSYVGITSSGVVWEMKPKQKWKPFSQKQIMSLEQAYSKRLASQDRGWVKLDSNFEVNFDKVPMEMRLPIRCPIKRDFLSGIQVEFKQSPHQRSLRARLYWLQVDNQLPGTMFPVVFHPVAPPKSIALDSEPKPFIDVSVITRFNEYSKVLQFKYFMVLIQEMALKVDQGFLGAVISLFTPTTDPEAERKRTKLIQQDIDALNTELMESSMTDMSILSFFEHFHISPVKLHLSLSLGSGGEESDKEKQEMIAIHSVNLLLKSIGATLTDVDDLIFKLAYYEIRYQFYKRDQLMWSVVRHYSEQFLKQMYVLVLGLDVLGNPFGLIRGLSEGVEALFYEPFQGAVQGPEEFAEGLVIGVRSLVGHTVGGAAGVVSRITGSVGKGLAAITMDKEYQQKRREEMGRQPKDFGDSLARGGKGFLRGVVGGVTGIITKPVEGAKKEGAAGFFKGIGKGLVGAVARPTGGIIDMASSTFQGIQRVAESTEEVSSLRPPRLIHEDGIIRPYDRQESEGSDLLENHIKKLEGEAYQFHCAVPGNKRAVLMITNRRALFIKEVEILGHMSVDWQCLFEDFVCPPEVSENLLKISVKEQGLFHKKDSANIGHLRKIYLKDPITAKRAFDAIESAQSARQQQKLMRQSSVKLLRPQGPS

SEQ ID NO: 3248 - protein, 3623 aa, Mus musculus
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAEKEEKSLQDIKQKELCRIEEALQKAAEKGAHSGEFMYGLENLLYKDVKPGRKRKKHKKHFKKRFKGLDRSKDKPKEAKKDTFLEKLATQVIKNVQVKITDIHIKYEDDITDPERPLSFGVTLREFSLLTTNEHWTPCILNEAEKIIYKLVKLDSLSAYWNVGCCMSYRGSREHILEQLKREILTSTNIPPDHQYIFQPISASAKLYMNPGAESELKTPKLDGNVEVQNIAIELTKPQYLSMIDFLESLDYMVRNAPYRKYKPCLPLHTNCRQWWKYAIDSVLEVHIRRYTQPWSWSNIKNHRQLLKSYKMAYKTKLTQAKVSEEIQKQIQDLEKSLDVFNIILVRQQAQVEVIHSGQKLRKKSAEAGEKRGWFSGFWGKKESKKRDEESSVPETIDDLMTPEEKDKLFTAIGYSENAYNLALPKQYVAHILTLKLVSTSIIIRENRNVPEILRVQIIGLGTQVSQRPGAQALKIEAKLEHWYVTGLRQQDIVPSLVASIGDTTSSLLKIEFETNPENSPADQTLIVQSQPVEVIYDAKTINAVVEFFQSNKGLDLEQITSATLMKLEEIKERTATGLTHIIETRKVLDLRINLKPSYLIIPQTGFHHEKSNLLILDFGTFQLNSKDQGAQKTANASLEEIIDKAYDKFDVEIRSVQLLFAKAEENWKKCRFQHPSTMHILQPMDIHVELAKAMVEKDVRMAKFKVSGGLPLMHVRISDQKIKDALCLINSIPLPQKSSTPSPERQVASIPVLSGGTKALLGTSLLLDGVESESDEEFFDAEDGDSQAARTVKASELKKAAEVPNEELVSLLLKFEIKEVVLELTKQQKEEETILVFNVTQLGTEATMRTFDLTAVSYLRKISLDYHDIKGSRKKPIHLISSSDRPGLDLLKVEYIKVDRNGPSFQTTFEKTEQTVKVAFSSLNLLLQTQALLSSLNYLTTVIPSDSQNTGVAKEVQAMPEKQKNSPLQKVMVPSRDSDVIGFRLFAKLNAFCVTVCDEKSNIAEIKIQGLDSSLSLQSKKQSLFARLENIIVTDVDPKTIHKKAVSIVGNEVFRFNLDLYPDATEGDSYTDMSTVDGVVALHVGCIQIVYLHKFLMSLLSFLNNFQVAKEALSAATAQAAEKAATSVKDLAQRSFRVSVDIDLKAPVIVIPQSSLSTNAVVVDLGLIRVHNRFSLVSGEDTANPPVIDKMEVQLTKLKLSRTAIQPGTSHPDIQLLHPINLEFFVSRNLAANWYHKVPVVEIKGRLDSMNVSLNQEDLNLLFRILAENLGEATEDLDKGKPRIQERGETKACREVSTPQDVHTTQGVPAARVEETRPVDIINVLLNFEIKEVVVTLMKKAERKGSPFHELKILHLGMEAKVKAHDMTAAAYLRNISMRCFHFPDSKGEPLRIVNTSDVSDGILLKLLFIKADSDGPDFKTIHDNTKQKLKVSFSSLDLVLHLEALLSLMDFLSSAIPSSDSSSSEKEPELKPLVGESRSLAIRAVPSSYEGDAFDLKITAELNAFNIFICDQKSNIAEIKIHGMDASISVKPKQTDVFARLKNIIVMNVDSLSIHKKAVSILGDEVFRFQMSLYPDATEGENYGDMSKVDGRLSLKVGCIQIVYVHKFFMSLLSFLNNFQAAKEALSTATVQAAERAASSVKDLAQKSFRLLMDIDLKAPVITIPQSSVSPNVVIADLGLIRVENKFSLVSVEQLALPPVADEMSIQLTQLKLARTVLQADSPQHDVEILKPVNMLLCIQRNLSAAWYTQIPGMEIKGELKPMQVALSQDDLTVLMKILLENLGEASSQPSPTQYAQEAARVKRDTRSGPDYLKEQELADPKPPGDQTVTLQFDFHFDSLSIILYNSDSSQEPRLSFHNDSFRLGELTLHLMASAGKMFKDGSMNVSLKLKTCTLDDLREGIERATSRMIDKKNDQDNNSSMIDISYSQDKNGSQVDAVLDKLYVCASVEFLMTVADFFIKAMPQSPENIAKEIQIPSRQTAAGRVKMEKDDSVRPNMTLKAMITDPEVVFVASLTKADAPALTASFQCNLSLSTSKLEQMMEASVRDLKVLACPFLRERRGKSITTVLQPCSLFMEKCTWASGKQNINIVVKEFVIKISPIILNTVMTIMAAMSPKTKEDEWKDTPKETDNLWAVKSITDYNSWFLGVDMATEVTENFRDSEHPSIEENCVVAVESVQVTLECGLGHRTVPLLLAESKFSGNIKNWTSLMAAAADMTLEVHYYNETHAVWEPLIERVEGNKPWSLKLNVKKNPIQDKSLMPGDDFIPEPQTAVHISSGATMNITISKSCLNVFSNLAKGFSEGAASTFDYSLKDRAPFTVKNALGVPMKVQPNRNLKVMGSPEKSDIYDVGAGQHLELDYASLEPSRQGKLSILSRQESSLFTLTFVPYGYTEVASVPVARPGRRLYNVRNPSASHSDSVLVQIDATEGNKVVTLRSPLQIKNHFSIAFIIYKFVKNVKLLERIGIARPEEEFHVPLDSYRCQLYVQPAGGLEQQYTHSSTYISWKEELHRSREVRCMLQCPAVEVSFLPLIVNTVALPDELSYIGAHGEDWDPAYVIHLYPPLTLRNLLPYSLRYLLEGTAETHELAEGSSADVLHSRISGEIIELVLVKYLGKNWNGHFRICDTLPEFFLVCFSSDTAEVMTVDLSVHVRRIGCRMELSVFSPYWLINKTSRVLQYRSEEIHVKHPADFRDIILFSFKKKNIFSKNKVQLKISTSAWSNGFSLDTVGSYGCVKCPATNMEYLVGVSIKMSSFNLSRVVTLTPFCTVANKSSLDLEVGEIASDGSIPTNKWHYVASSECIPFWPENLSGKLCVRVVGYEGSSKPFFYNRQDNGTLLSLEDLNGGILVDINTAEHSTVITFSDYHEGSAPALIMNHTQWDVLTYKQSGSQEELVLLPGETRLFAWADPTGIRKLTWNYAANFGEHDLLKDECGQFPYDANIQIHWVSFLDGRQRVLLFTDDVALVSKALQAEEMEQADHEVALSLHSLGLSLVNNENKQEVSYVGITSSGVVWEMKPKQKWKPFSQKQIMSLEQAYSKRLASQDRGWVKLDSNFEVNFDKVPMEMRLPIRCPIKRDFLSGIQVEFKQSPHQRSLRARLYWLQVDNQLPGTMFPVVFHPVAPPKSIALDSEPKPFIDVSVITRFNEYSKVLQFKYFMVLIQEMALKVDQGFLGAVISLFTPTTDPEAERKRTKLIQQDIDALNTELMESSMTDMSILSFFEHFHISPVKLHLSLSLGSGGEESDKEKQEMIAIHSVNLLLKSIGATLTDVDDLIFKLAYYEIRYQFYKRDQLMWSVVRHYSEQFLKQMYVLVLGLDVLGNPFGLIRGLSEGVEALFYEPFQGAVQGPEEFAEGLVIGVRSLVGHTVGGAAGVVSRITGSVGKGLAAITMDKEYQQKRREEMGRQPKDFGDSLARGGKGFLRGVVGGVTGIITKPVEGAKKEGAAGFFKGIGKGLVGAVARPTGGIIDMASSTFQGIQRVAESTEEVSSLRPPRLIHEDGIIRPYDRQESEGSDLLEQEMGTQE

SEQ ID NO: 3249 - protein, 3708 aa, Mus musculus
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAEKEEKSLQDIKQKELCRIEEALQKAAEKGAHSGEFMYGLENLLYKDVKPGRKRKKHKKHFKKRFKGLDRSKDKPKEAKKDTFLEKLATQVIKNVQVKITDIHIKYEDDITDPERPLSFGVTLREFSLLTTNEHWTPCILNEAEKIIYKLVKLDSLSAYWNVGCCMSYRGSREHILEQLKREILTSTNIPPDHQYIFQPISASAKLYMNPGAESELKTPKLDGNVEVQNIAIELTKPQYLSMIDFLESLDYMVRNAPYRKYKPCLPLHTNCRQWWKYAIDSVLEVHIRRYTQPWSWSNIKNHRQLLKSYKMAYKTKLTQAKVSEEIQKQIQDLEKSLDVFNIILVRQQAQVEVIHSGQKLRKKSAEAGEKRGWFSGFWGKKESKKRDEESSVPETIDDLMTPEEKDKLFTAIGYSENAYNLALPKQYVAHILTLKLVSTSIIIRENRNVPEILRVQIIGLGTQVSQRPGAQALKIEAKLEHWYVTGLRQQDIVPSLVASIGDTTSSLLKIEFETNPENSPADQTLIVQSQPVEVIYDAKTINAVVEFFQSNKGLDLEQITSATLMKLEEIKERTATGLTHIIETRKVLDLRINLKPSYLIIPQTGFHHEKSNLLILDFGTFQLNSKDQGAQKTANASLEEIIDKAYDKFDVEIRSVQLLFAKAFKVSGGLPLMHVRISDQKIKDALCLINSIPLPQKSSTPSPERQVASIPVLSGGTKALLGTSLLLDGVESESDEEFFDAEDGDSQAARTVKASELKKAAEVPNEELVSLLLKFEIKEVVLELTKQQKEEETILVFNVTQLGTEATMRTFDLTAVSYLRKISLDYHDIKGSRKKPIHLISSSDRPGLDLLKVEYIKVDRNGPSFQTTFEKTEQTVKVAFSSLNLLLQTQALLSSLNYLTTVIPSDSQNTGVAKEVQAMPEKQKNSPLQKVMVPSRDSDVIGFRLFAKLNAFCVTVCDEKSNIAEIKIQGLDSSLSLQSKKQSLFARLENIIVTDVDPKTIHKKAVSIVGNEVFRFNLDLYPDATEGDSYTDMSTVDGVVALHVGCIQIVYLHKFLMSLLSFLNNFQVAKEALSAATAQAAEKAATSVKDLAQRSFRVSVDIDLKAPVIVIPQSSLSTNAVVVDLGLIRVHNRFSLVSGEDTANPPVIDKMEVQLTKLKLSRTAIQPGTSHPDIQLLHPINLEFFVSRNLAANWYHKVPVVEIKGRLDSMNVSLNQEDLNLLFRILAENLGEATEDLDKGKPRIQERGETKACREVSTPQDVHTTQGVPAARVEETRPVDIINVLLNFEIKEVVVTLMKKAERKGSPFHELKILHLGMEAKVKAHDMTAAAYLRNISMRCFHFPDSKGEPLRIVNTSDVSDGILLKLLFIKADSDGPDFKTIHDNTKQKLKVSFSSLDLVLHLEALLSLMDFLSSAIPSSDSSSSEKEPELKPLVGESRSLAIRAVPSSYEGDAFDLKITAELNAFNIFICDQKSNIAEIKIHGMDASISVKPKQTDVFARLKNIIVMNVDSLSIHKKAVSILGDEVFRFQMSLYPDATEGENYGDMSKVDGRLSLKVGCIQIVYVHKFFMSLLSFLNNFQAAKEALSTATVQAAERAASSVKDLAQKSFRLLMDIDLKAPVITIPQSSVSPNVVIADLGLIRVENKFSLVSVEQLALPPVADEMSIQLTQLKLARTVLQADSPQHDVEILKPVNMLLCIQRNLSAAWYTQIPGMEIKGELKPMQVALSQDDLTVLMKILLENLGEASSQPSPTQYAQEAARVKRDTRSGPDYLKEQELADPKPPGDQTVTLQFDFHFDSLSIILYNSDSSQEPRLSFHNDSFRLGELTLHLMASAGKMFKDGSMNVSLKLKTCTLDDLREGIERATSRMIDKKNDQDNNSSMIDISYSQDKNGSQVDAVLDKLYVCASVEFLMTVADFFIKAMPQSPENIAKEIQIPSRQTAAGRVKMEKDDSVRPNMTLKAMITDPEVVFVASLTKADAPALTASFQCNLSLSTSKLEQMMEASVRDLKVLACPFLRERRGKSITTVLQPCSLFMEKCTWASGKQNINIVVKEFVIKISPIILNTVMTIMAAMSPKTKEDEWKDTPKETDNLWAVKSITDYNSWFLGVDMATEVTENFRDSEHPSIEENCVVAVESVQVTLECGLGHRTVPLLLAESKFSGNIKNWTSLMAAAADMTLEVHYYNETHAVWEPLIERVEGNKPWSLKLNVKKNPIQDKSLMPGDDFIPEPQTAVHISSGATMNITISKSCLNVFSNLAKGFSEGAASTFDYSLKDRAPFTVKNALGVPMKVQPNRNLKVMGSPEKSDIYDVGAGQHLELDYASLEPSRQGKLSILSRQESSLFTLTFVPYGYTEVASVPVARPGRRLYNVRNPSASHSDSVLVQIDATEGNKVVTLRSPLQIKNHFSIAFIIYKFVKNVKLLERIGIARPEEEFHVPLDSYRCQLYVQPAGGLEQQYTHSSTYISWKEELHRSREVRCMLQCPAVEVSFLPLIVNTVALPDELSYIGAHGEDWDPAYVIHLYPPLTLRNLLPYSLRYLLEGTAETHELAEGSSADVLHSRISGEIIELVLVKYLGKNWNGHFRICDTLPEFFLVCFSSDTAEVMTVDLSVHVRRIGCRMELSVFSPYWLINKTSRVLQYRSEEIHVKHPADFRDIILFSFKKKNIFSKNKVQLKISTSAWSNGFSLDTVGSYGCVKCPATNMEYLVGVSIKMSSFNLSRVVTLTPFCTVANKSSLDLEVGEIASDGSIPTNKWHYVASSECIPFWPENLSGKLCVRVVGYEGSSKPFFYNRQDNGTLLSLEDLNGGILVDINTAEHSTVITFSDYHEGSAPALIMNHTQWDVLTYKQSGSQEELVLLPGETRLFAWADPTGIRKLTWNYAANFGEHDLLKDECGQFPYDANIQIHWVSFLDGRQRVLLFTDDVALVSKALQAEEMEQADHEVALSLHSLGLSLVNNENKQEVSYVGITSSGVVWEMKPKQKWKPFSQKQIMSLEQAYSKRLASQDRGWVKLDSNFEVNFDKVPMEMRLPIRCPIKRDFLSGIQVEFKQSPHQRSLRARLYWLQVDNQLPGTMFPVVFHPVAPPKSIALDSEPKPFIDVSVITRFNEYSKVLQFKYFMVLIQEMALKVDQGFLGAVISLFTPTTDPEAERKRTKLIQQDIDALNTELMESSMTDMSILSFFEHFHISPVKLHLSLSLGSGGEESDKEKQEMIAIHSVNLLLKSIGATLTDVDDLIFKLAYYEIRYQFYKRDQLMWSVVRHYSEQFLKQMYVLVLGLDVLGNPFGLIRGLSEGVEALFYEPFQGAVQGPEEFAEGLVIGVRSLVGHTVGGAAGVVSRITGSVGKGLAAITMDKEYQQKRREEMGRQPKDFGDSLARGGKGFLRGVVGGVTGIITKPVEGAKKEGAAGFFKGIGKGLVGAVARPTGGIIDMASSTFQGIQRVAESTEEVSSLRPPRLIHEDGIIRPYDRQESEGSDLLENHIKKLEGEAYQFHCAVPGNKRAVLMITNRRALFIKEVEILGHMSVDWQCLFEDFVCPPEVSENLLKISVKEQGLFHKKDSANIGHLRKIYLKDPITAKRAFDAIESAQSARQQQKLMRQSSVKLLRPQGPS

SEQ ID NO: 3250 - protein, 539 aa, Mus musculus
MWSGRSSFTSLVVGVFLVYVVHTCWVMYGIVYTRPCSGDSNCIQPYLALRPKLQLSVYTTTRSSLGAENNVDLILNVEDFDVDSKFERTVNVSVPKKTRNNGTLYAYIFLHHAGILPWQDGKQVHVVSTLTTYMIPKPEEINLLTGESATQQQIEAEKKPSNALDEPVSHWRPRLTLNVMVDDFVFDGSSLPADVHRYMKMIQLGKTVHYLPILFIDQLSNRVKDLMVINRSTTELPLTVSYDKISLGRLRFWIHMQDAVYSLQQFGFSEKDADELKGIFVDTNLYLLALTFFVAAFHLLFDFLAFKSDISFWKKKKSMIGMSTKAVLWRCFSTVVIFLFLLDEQTSLLVLIPAGVGAAIELWKVKKALKITVAWRGLRPVFQFGTHSESERKTEKYDAQAMKYLSYLLYPLCVGGAVYSLLNIKYKSWYSWLINSFVNGVYAFGFLFMLPQLFVNYKMKSVAHLPWKAFTYKAFNTFIDDVFAFIITMPTSHRLACFRDDVVFLVYLYQRWLYPVDKSRVNEFGESYEEQPKRKPHPD

SEQ ID NO: 3251 - protein, 83 aa, Mus musculus
LKSRLKIAQPLHLPPRPDNDGFRAKMYDITQHPFFKRTIALLVLAQSVLLSVKWDVDDPVTVPLATMSVVFTFIFVLEVTMKI

SEQ ID NO: 3252 - protein, 77 aa, Mus musculus; identical to SEQ ID NO: 2968

SEQ ID NO: 3253 - protein, 420 aa, Mus musculus
MAFIAALGLLMAEICPAVICCSDGTLGMHNAVQKGQDTQKQLDSLTLASINTDFAFSFYKELALKNPHKNIAFSPFGIATALNSLTLGAKGNTLEEILEVLKFNLTETSEADIHQGFKHLLQRLSHPGDQVQIRTGNALFVEKHLQILAEFKEKARALYHTEVFTANFQQPHEAMKLINSYMSNQTQGKIKELVSDMDGNTSMVIVNDLFFKAEWMVPFNSDDTFMGKFIVDRSRHVKVPMMKTKNLRTPYFRDEELKCTVVELNYKGNGKAMFILPDQGKMQQVEASLQPGTLKKWRKSLRPRKIKELHLPKFSLSQHYNLEDILPELGIRELFSTQADLSGITGVKNITVSEMIHSTELDMTEKGTEGDAITIVGYNFMSAKLKPVFVKFEDQFLYIVLDQGDLWIHVMGKVINPSEK

SEQ ID NO: 3254 - protein, 335 aa, Mus musculus
MPVLHIHGSEDHLGTLDHLVSVIILVYYSGHLATAQEKQSPIKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPIILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVEDLTDVSVHLRSRSRVNGTVSIPLA

SEQ ID NO: 3255 - protein, 88 aa, Mus musculus
TTILCLGPSDLLVKLRLCFLVMAYGTTIFHPLLYAFTRQKFQKVLKSKMKKRVVSIVEADPMPNNAVIHNSWIDPKRNKKVTYEDSEI

SEQ ID NO: 3256 - protein, 72 aa, Mus musculus
TILCLGPSDLLVKLRLCFLVMAYGTTIFHPLLYAFTRQKFQKVLKSKMKKRVVSIVEADPMPNNAVIHNSWI

SEQ ID NO: 3257 - protein, 725 aa, Mus musculus
MAAPGARGASLSGLLPAQTSLEYALLDAVTQQEKDELVYQYLQKVDGWEQDLAVPEFPEGLEWLNTEEPLSIYKDLCGKVVVLDFFTYCCINCIHVLPDLHALERRFSDKDGLLIVGVHSAKFPNEKVLDNIKSAVLRYNITHPVVNDADASLWQELEVSCWPTLVILGPRGNLLFSLIGEGHRDKLFSYTSIALKYYKDRGQIRDGKIGIKLFKESLPPSPLLFPGKVAVDHATGRLVVADTGHHRILVIQKNGRIQSSIGGPNPGRKDGMFSESSFNSPQGVAIADNVIYVADTENHLIRKIDLEAEKVTTVAGVGIQGTDTEGGEEGDKQPISSPWDVALGTSGSEVQRNDILWIAMAGTHQIWALLLDSGTLPKKSDLKKGTCIRFAGSGNEENRNNAYPHKAGFAQPSGLALASEEPWSCLFVADSESSTVRTVSLRDGAVKHLVGGERDPMNLFAFGDVDGAGINAKLQHPLGVAWDEERQVLYVADSYNHKIKVVDPKTKGCTTLAGTGDASDASSSFAESAFNEPGGLCIGESGRLLYVADTNNHQIKVMDLEARTVSVLPVCKSDSAVVDGSFPREKQKTVPKVPKSAAHIGLPPVTVHPGQALQLRLKLQLPPGAKLTEGAPSCWFLEAEGNEWLLQEQTPSGDIENISNQPAISLQIPTHCLSLEAVVSVVVFLYYCSADSSACMMKGVVFRQPLQITSTQPACAAPVELAYAF

SEQ ID NO: 3258 - protein, 119 aa, Mus musculus
ATMWDYTIPILEIKLKIVPVLGVVGGLIFSCSNYFHVILHGGVGKNGSTIAGTSVLSPGLHIGLIIILAIMIYKKSATNMFEKHPCLYTLMFGCVFAKVAQKLVIAHMTKSELYLQDTV

SEQ ID NO: 3259 - protein, 110 aa, Mus musculus
WDYTIPILEIKLKIVPVLGVVGGLIFSCSNYFHVILHGGVGKNGSTIAGTSVLSPGLHIGLIIILAIMIYKKSATNMFEKHPCLYTLMFGCVFAKVAQKLVIAHMTKSEL

SEQ ID NO: 3260 - protein, 930 aa, Mus musculus
MNKIRKFFRGSGRVLAFIFAASVIWLLFDMAALRLSFSEINAGLLKEDIIRREHTGFRVEPDQVKVLYTSIRGMGLPRNGAWGKENFRKAENHELKVEENMDQVQRKGKMQNLLGRRKAVPLWHLAHLQTLPVTIPMQKTQGRDSKPEVSSQYMMSKWMTVLESEKTPFTASRGVPLTKIAGRTETFDKKQEAPQNYNVSSDTSKQASERTLNMTISVKTDRSKQKSQTVTKLRMHFASPPILKSEEVTVIKKAEAQSKDLKHEALKALPLLKFIADMGHLKNQSTNETQLGRLPEDDAAKVAPGKKLNFSESHVVIITKEEELKTDTKEVPNSKTQTVFPKLLGGSPHKQIPRNQSKTSSSPPALKKAVSQSKPTISGGLHTARSNLTAKAPTVGYQQSHANIPENPGMHHVFRIDVTLSPRDLNAPGQFGRPVVVPPEKKKEAEQRWKEGNFNVYLSDLIPVDRAIEDTRPAGCAEQLVHNDLPTTSIIMCFVDEVWSALLRSVHSVLNRSPPHLIKEILLVDDFSTKEYLKADLDKYMSQFPKVRILRLKERHGLIRARLAGAQNATGDVLTFLDSHVECNVGWLEPLLERVYLNRKKVACPVIEVINDKDMSYMTVDNFQRGVFTWPMNFGWKTIPPDVVAKNGIKETDIIRCPVMAGGLFSIDKSYFYELGTYDPGLDVWGGENMELSFKVWMCGGEIEIIPCSRVGHIFRNDNPYSFPKDRMKTVERNLVRVAEVWLDDYRELFYGHGDHLIDQGLDVGNLTQQRELRKKLKCKSFKWYLDNVFPDLKAPVVRASGVLINMALGKCVSIENITVTLEDCDGSSQLQQFNYTWVRLIKHGEWCVAPIPEKGSLTLYHCDNRNNRLKWLHKSASAFHPELVDHIVFENYQQLLCMEGNFSQKTLKLAACNPMELQQKWKFEKYYEV

SEQ ID NO: 3261 - protein, 458 aa, Mus musculus
MNKTTSEVWLIDGLSPWDPPVLIQKRIHGMLYYVEHRDDELYILTNVGEPTEFKLMRTAADAPAIMNWDLFFTMKRNTKVVDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRIEAKSKDGKLVPMTVFHKTDSEDLQRKPLLVHVYGAYGMDLKMNFRPEKRVLVDDGWILAYCHVRGGGELGLQWHADGRLTKKLNGLADLVACIKTLHSQGFSQPSLTTLSAFSAGGVLVGALCNSKPELLRAVTLEAPFLDVLNTMLDTTLPLTLEELEEWGNPSSDEKHKNYIKRYCPCQNIKPQHYPSVHITAYENDERVPLKGIVNYTEKLKEAVAEHTKGAGEGYQPPNIILDIQPGGNHVIEDSHKKITTQMKFLYEELGLDSTDAFEALKKYLKF

SEQ ID NO: 3262 - protein, 520 aa, Mus musculus
MAEVKLGMKTQVPASVESQKPRSKKAPDFPIVEKQNWLIHLHYIRKDYEACKAVIKEQLQETQGLCEYAIYVQALIFRLEGNIQESLELFQTCAVLSPQCADNLKQVARSLFLLGKHKAATEVYNEAAKLNQKDWEICHNLGVCYTYLKQFNKAQDQLHSALQLNKHDLTYIMLGKIHLLQGDLDKAIEIYKKAVEFSPENTELLTTLGLLYLQLGVYQKAFEHLGNALTYDPANYKAILAAGSMMQTHGDFDVALTKYRVVACAIPESPPLWNNIGMCFFGKKKYVAAISCLKRANYLAPFDWKILYNLGLVHLTMQQYASAFHFLSAAINFQPKMGELYMLLAVALTNLEDIENARRAYVEAVRLDKCNPLVNLNYAVLLYNQGEKKSALAQYQEMEKKVNFLKDNSPLEFDSEMVEMAQKLGAALQVGEALVWTKPVKDPKTKHRTNSGSKSATLQQPLGSIQALGQAMSSAAAYRKILSGAVGAQLPKPPSLPLEPEPEPTVEASPTEASEQKKEK

SEQ ID NO: 3263 - protein, 487 aa, Mus musculus
MGVIGIQLVVTMVMASVMQKIIPHYSLARWLLCNGSLRWYQHPSEEELRILAGKQQKGKSKKDRKYNGHIENKPLTIPKDIDLHLETKSVTEVDTLALHYFPEYQWLVDFTVAATIVYLVTEVYYSFMKPTQEMNISLVWCLLVLSFAIKVLFSLTTHYFKVEDGGERSVCVTFGFFFFVKAMAVLIVTENYLEFGLETGFTNFSDSAMQFLEKQGLESQGPVSKLTFKFFLAVFCSLIGAFLTFPGLRLAQMHLDALNMATEKITQTLLHINFLAPLFMVLLWVKPITKDYIMNPPLGRESVPLMTEATFDTLRLWLIILLCVLRLAMMRSHLQAYLNLAQKCVDQMKKEAGRISTVELQKMVARVFYYLCVIALQYVAPLVMLLHMTLLLKTLGNHSWGIYPEAAFPLPVDNNLPANSAYPELPSPDGKMKVTVTQITVALSSLKNIFTPLLFRGLLSFLTWWIAACLFSTSLFGLFYHQYLTVA

SEQ ID NO: 3264 - protein, 123 aa, Mus musculus
MGVIGIQLVVTMVMASVMQKIIPHYSLARWLLCNGSLRWYQHPSEEELRILAGKQQKGKSKKDRKYNGHIENKPLTIPKDIDLHLETKSVTEVDTLALHYFPEYQWLVDFTVAATIVYLVTEV

SEQ ID NO: 3265 - protein, 144 aa, Mus musculus
LVVTMVMASVMQKIIPHYSLARWLLCNGSLRWYQHPSEEELRILAGKQQKGKSKKDRKYNGHIENKPLTIPKDIDLHLETKSVTEVDTLALHYFPEYQWLVDFTVAATIVYLVTEVYYSFMKPTQEMNISLVWCLLVLSFAIKV

SEQ ID NO: 3266 - protein, 651 aa, Mus musculus
MWALVGRALAPWAAGARHAAASEPRAACRLFSAAELKEKPDMSRFPVEDIRNFSIIAHVDHGKSTLADRLLELTGTIDKTKKNKQVLDKLQVERERGITVKAQTASLFYSFGGKQYLLNLIDTPGHVDFSYEVSRSLSACQGVLLVVDANEGIQAQTVANFFLAFEAQLSVIPVINKIDLKNADPERVGKQIEKVFDIPSEECIKISAKLGTNVDSVLQAVIERIPPPKVHRENPLKALVFDSTFDQYRGVIANIALFDGVVSKGDKIVSAHTKKAYEVNEVGILNPNEQPTHKLYAGQVGFLIAGMKDVTEAQIGDTLYLHNHPVEPLPGFKSAKPMVFAGVYPIDQSEYNNLKSAIEKLTLNDSSVTVHRDSSLALGAGWRLGFLGLLHMEVFNQRLEQEYNASVILTTPTVPYKAVLSSAKLIKEYKEKEITIINPAQFPEKSQVTEYLEPVVLGTVITPTEYTGKIMALCQARRAIQKNMTFIDENRVMLKYLFPLNEIVVDFYDSLKSLSSGYASFDYEDAGYQTAELVKMDILLNGNMVEELVTVVHREKAYTVGKSICERLKESLPRQLYEIAIQAAVGSKVIARETVKAYRKNVLAKCYGGDITRKMKLLKRQSEGKKKLRKIGNIEIPKDAFIKVLKTQPNK

SEQ ID NO: 3267 - protein, 866 aa, Mus musculus
MAYYMDTWAAAPAERPGMIASLSLSFKKAFAELFPQRRRGHSEGDYPPLRGSANNSLEEHYRWQIPIKHNVFEILKSNESQLCEVLQNKFGCISTLSCPTLAGSSSPAQRVFRRTLIPGIELSVWKDDLTRHVVDAVVNAANENLLHGSGLAGSLVKTGGFEIQEESKRIIANVGKISVGGIAITGAGRLPCHLIIHAVGPRWTVTNSQTAIELLKFAIRNILDYVTKYDLRIKTVAIPALSSGIFQFPLDLCTSIILETIRLYFQDKQMFGNLREIHLVSNEDPTVASFKSASESILGRDLSSWGGPETDPASTMTLRIGRGLTLQIVQGCIEMQTTDVIVNSGYMQDFKSGRVAQSILRQAGVEMEKELDKVNLSTDYQEVWVTKGFKLSCQYVFHVAWHSQINKYQILKDAMKSCLEKCLKPDINSISFPALGTGLMDLKKSTAAQIMFEEVFAFAKEHKEKTLTVKIVIFPVDVETYKIFYAEMTKRSNELNLSGNSGALALQWSSGEQRRGGLEAGSPAINLMGVKVGEMCEAQEWIERLLVSLDHHIIENNHILYLGKKEHDVLSELQTSTRVSISETVSPRTATLEIKGPQADLIDAVMRIECMLCDVQEEVAGKREKNLWSLSGQGTNQQEKLDKMEESYTFQRYPASLTQELQDRKKQFEKCGLWVVQVEQIDNKVLLAAFQEKKKMMEERTPKGSGSQRLFQQVPHQFCNTVCRVGFHRMYSTSYNPVYGAGIYFTKSLKNLADKVKKTSSTDKLIYVFEAEVLTGSFCQGNSSNIIPPPLSPGALDVNDSVVDNVSSPETIVVFNGMQAMPLYLWTCTQDRTFSQHPMWSQGYSSGPGMVSSLQSWEWVLNGSSV

SEQ ID NO: 3268 - protein, 830 aa, Mus musculus
MAYYMDTWAAAPAERPANNSLEEHYRWQIPIKHNVFEILKSNESQLCEVLQNKFGCISTLSCPTLAGSSSPAQRVFRRTLIPGIELSVWKDDLTRHVVDAVVNAANENLLHGSGLAGSLVKTGGFEIQEESKRIIANVGKISVGGIAITGAGRLPCHLIIHAVGPRWTVTNSQTAIELLKFAIRNILDYVTKYDLRIKTVAIPALSSGIFQFPLDLCTSIILETIRLYFQDKQMFGNLREIHLVSNEDPTVASFKSASESILGRDLSSWGGPETDPASTMTLRIGRGLTLQIVQGCIEMQTTDVIVNSGYMQDFKSGRVAQSILRQAGVEMEKELDKVNLSTDYQEVWVTKGFKLSCQYVFHVAWHSQINKYQILKDAMKSCLEKCLKPDINSISFPALGTGLMDLKKSTAAQIMFEEVFAFAKEHKEKTLTVKIVIFPVDVETYKIFYAEMTKRSNELNLSGNSGALALQWSSGEQRRGGLEAGSPAINLMGVKVGEMCEAQEWIERLLVSLDHHIIENNHILYLGKKEHDVLSELQTSTRVSISETVSPRTATLEIKGPQADLIDAVMRIECMLCDVQEEVAGKREKNLWSLSGQGTNQQEKLDKMEESYTFQRYPASLTQELQDRKKQFEKCGLWVVQVEQIDNKVLLAAFQEKKKMMEERTPKGSGSQRLFQQVPHQFCNTVCRVGFHRMYSTSYNPVYGAGIYFTKSLKNLADKVKKTSSTDKLIYVFEAEVLTGSFCQGNSSNIIPPPLSPGALDVNDSVVDNVSSPETIVVFNGMQAMPLYLWTCTQDRTFSQHPMWSQGYSSGPGMVSSLQSWEWVLNGSSV

SEQ ID NO: 3269 - protein, 747 aa, Mus musculus
MASRVTDAIVWYQKKIGAYDQQIWEKSVEQREIKGLRNKPKKTAHVKPDLIDVDLVRGSAFAKAKPESPWTSLTRKGIVRVVFFPFFSRWWLQVTSRVIFSWLLVLYLLQVAAIVLFCSAPSPHSIPLTEVIGPIWLMLLLGTVHCQIVSTRTPKPPLGTGGKRRRKLRKAAHLEVHREGDGSSTTDNTQEGAVQSYGAGAPYSVGTVFRDLWLAAFFLSGSKKAKNSIDKSTETDNGYVSLDGKRTVKSSEDGAQYHELQCETVGPEDAAWATRTPRSVPAKDTQRKITNVSDEVSSEEGPETGYPLRGHVDRTSESGLRNRKPHHYKKHYANEDAPKSGTSCSSRCSSSRQDSESTRPESETEGVLWEDLLHCAECRSSCTSETDVGNPQINPCGKKEYRDDPFHQSHLPWLHSSHPGLEKISAIVWEGNDCKKADMSVLEISGMIMNRVNNHVPGIGYQVFGNAISLILGLTPFVFRLSQATDLEQLTAHSASELYVIAFGSNEDVMVLSMVLISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHCNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 3270 - protein, 95 aa, Mus musculus
GPQRSVDVIVSSAFLLTISVVFICCAQLLHVHEIFLDCHCNWELVIWCISLTLFLLRFVTLGSETSKKYSNTSILLTEQINLYLKMEKKPNKKEE

SEQ ID NO: 3271 - protein, 103 aa, Mus musculus
VDVIVSSAFLLTISVVFICCAQLLHVHEIFLDCHCNWELVIWCISLTLFLLRFVTLGSETSKKYSNTSILLTEQINLYLKMEKKPNKKEELTLVNNVLKLATK

SEQ ID NO: 3272 - protein, 74 aa, Mus musculus
LQEYLSGINSDPVRSKFCKIRVLCHTLARNMVYVLTITTPLKTSDSKRKAVILTARVHPGETNSSWIMKGFLDY

SEQ ID NO: 3273 - protein, 77 aa, Mus musculus
CKIRVLCHTLARNMVYVLTITTPLKTSDSKRKAVILTARVHPGETNSSWIMKGFLDYILGDSSDARLLRDTFIFKVV

SEQ ID NO: 3274 - protein, 74 aa, Mus musculus; identical to SEQ ID NO: 3272

SEQ ID NO: 3275 - protein, 77 aa, Mus musculus; identical to SEQ ID NO: 3273

SEQ ID NO: 3276 - protein, 74 aa, Mus musculus; identical to SEQ ID NO: 3272

SEQ ID NO: 3277 - protein, 77 aa, Mus musculus; identical to SEQ ID NO: 3273

SEQ ID NO: 3278 - protein, 98 aa, Mus musculus
AGHEIQITEGKDCYGAFVWPSALVLCYFLETHAKQYNMVDKNVIEIGAGTGLVSIVASLLGARVIATDLPELLGNLQYNISRNTKMKCKHLPQVKELS

SEQ ID NO: 3279 - protein, 75 aa, Mus musculus
YFLETHAKQYNMVDKNVIEIGAGTGLVSIVASLLGARVIATDLPELLGNLQYNISRNTKMKCKHLPQVKELSWGV

SEQ ID NO: 3280 - protein, 617 aa, Mus musculus
MDLKTAVFNAARDGKLRLLTKLLASKSKAEVSSLISEKTNGATPLLMAARYGHLDMVEFLLEQCSASIEVGGSVNFDGETIEGAPPLWAASAAGHLKVVQSLLNHGASVNNTTLTNSTPLRAACFDGHLEIVKYLVEHKADLEVSNRHGHTCLMISCYKGHKEIAQYLLEKGADVNRKSVKGNTALHDCAESGSLDIMKMLLMYCAKMEKDGYGMTPLLSASVTGHTNIVDFLTHHAQTSKTERINALELLGATFVDKKRDLLGALKYWKKAMNMRYSDRTNIISKPVPQTLIMAYDYAKEVNSAEELEGLIADPDEMRMQALLIRERILGPSHPDTSYYIRYRGAVYADSGNFKRCINLWKYALDMQQSNLDPLSPMTASSLLSFAELFSFMLQDRAKGLLGTTVTFDDLMGILCKSVLEIERAIKQTQCPADPLQLNKALSIILHLICLLEKVPCTVEQDHFKKQTIYRFLKLHPRGKNNFSPLHLAVDKNTTCVGRYPVCKFPSLQVTAILIECGADVNVRDSDDNSPLHIAALNNHPDIMNLLIKSGAHFDATNLHKQTASDLLDEKEIAKNLIQPINHTTLQCLAARVIVNHRIYYKGNIPEKLETFVSLHR

SEQ ID NO: 3281 - protein, 1642 aa, Rattus norvegicus
MATAIRDVGVWRQTRTLLLKNYLVKCRTKKSSVQEILFPLFFLFWLILISMMHPNKKYEEVSDIELSPMDKSILSNLILGYTPVTNTTSSVMQRVSTDHLPDVLVTEEYASEKELLASSLSKPSNFVGVVFKDVMSYELRFFPDMVPVSSVYMDSRAGCSKSCDAAQYWSSGFTALQASIDAAIIQLKTNVSLWRELESTKAVIMGEAAVVEIDTFPRGVILIYLVIAFSPFGYFLAIHIVAEKEKRLKEFLKIMGLHDTAFWLSWVLLYTSLIFLMSLLMAVIATASSLFPQSSSIVIFLLFFLYGLSSVFFALMLTPLFKKSKHVGVVEFFVTVVFGFVGLLIVLVESFPRSLVWLFSPLCQCAFLIGIAQVMHLEDFNEGALFSSLTEGPYPLIITLTMLALDSVFYALLAVYLDQVIPGEFGLRRSSLYFLKPSYWSKNKRNYKELSEGNINGNISLNEIVEPVSSEFIGKEAIRISGIQKAYRKKNETVEALRNLSFDIYEGQITALLGHSGTGKSTLMNILCGLCPPSDGFASIYGHRVSEIDEMFEARKMIGICPQSDMNFDVLTVEENLSILASVKGIPANNIIQEVQKVLLDLDMQAIKDNQAKKLSGGQKRKLSLGIAVLGNPKILLLDEPTAGMDPCSRHIVWNLLKYRKANRVTVFSTHFMDEADILADRKAVISQGMLKCVGSSIFLKSKWGIGYRLSMYIDRYCATESLSSLVRQHIPAAALLQQNDQQIVYSLPFKDMDKFSGLFSALDIHSNLGVISYGVSMTTLEDVFLKLEVEAEIDQADYSVFTQQPREEETDSKSFDEMEQSLLILSETKASLVSTMSLWKQQVSTIAKFHFLSLKRESKSVRSVLLLLLIFFAVQIFMFLVHHSFKNAVVPIKLVPDLYFLKPGDKPHKYKTSLLLQNSTDSDINDLIDFFTQQNIIVAMFNDSDYVSAAPHSAALNVVQSEKDYVFTAVFNSTMVYSLPVMMNIISNYYLYHLNVTDTIQIWSTPFIQEITDIVFKVELYFQAALLGIIVTAMPPYFAMENAENHKIKAYTQLKLSGLLPSAYWIGQAVVDIPLFFVVLTLMLGSLFAFHHGLYFYPVKFLAVVFCLIAYVPSVILFTYIASFTFKKILNTKEFWSFIYSVTALACVAVTEITFFLGYGVTAVFHYTFCIAIPIYPLLGCLISFIKGSWKNIPKTENAYNPWDRLLVAVIMPYLQCVLWIFLLQHYEKKHGGRSIRKDPLFRALSQKAKHKKFPEPPINEDEDEDVKAERLKVKELMGCQCCEEKPAIMVYNLHKEYDDKKDFLHSRKTTKVATKYVSFCVKKGEILGLLGPNGAGKSTIINILVGDVEPTSGKIFLGDYGSHSNEDDESTKCMGYCPQTNPLWPDITLQEHFEIYGAVKGMSSGDMKEVISRITKALDLKEHLQKTVKKLPAGIKRKLCFALSMLGNPQVTLLDEPSTGMDPRAKQHMWRAIRTAFKNKKRAALLTTHYMEEAEAVCDRVAIMVSGQLRCIGTVQHLKSKFGKGYFLEIKLKDWIENLEIDRLQREIQYIFPNASRQESFSSILAYKIPKEDVQSLSQSFAKLEEAKHTFAIEEYSFSQATLEQVFVELTKEQEEEDNSCGTLNSTLWWERRQEDRVVF

SEQ ID NO: 3282 - protein, 103 aa, Mus musculus
VVAIVGLYRTGKSYLMNKLAGKEKGFSVGSTVQSHTKGIWMWCVPHPQKPDHTLVLLDTEGLGDVEKDDKKNDTQIFALAILLSSTFVYNTMNKIDQGAIDLL

SEQ ID NO: 3283 - protein, 123 aa, Mus musculus
MPEPLCLIGSTEGHLVTNQEALKILSAITQPVVVVAIVGLYRTGKSYLMNKLAGKEKGFSVGSTVQSHTKGIWMWCVPHPQKPDHTLVLLDTEGLGDVEKDDKKNDTQIFALAILLSSTFVYN

SEQ ID NO: 3284 - protein, 1085 aa, Rattus norvegicus
MAGPGSLCCASRGASALLATALLYAALGDVVRSEQQIPLSVVKLWASAFGGEIKSIAAKYSGSQLLQKKYKEYEKDVAIEEIDGLQLVKKLAKNMEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIITYNEELHYVEPCLNGTLVQADRTNKEHFREHLDKLFAKGIGMLDIALNEAFNVLSDFNHTGQGSICSQAIMLITDGAVDTYDTIFAKYNWPERKVRIFTYLIGREAAFADNLKWMACANKGFFTQISTLADVQENVMEYLHVLSRPKVIDQEHDVVWTEAYIDSTLADDQGLVLMTTVAMPVFSKQNETRSKGILLGVVGTDVPVKELLKTIPKYKLGIHGYAFAITNNGYILTHPELRPLYEEGKKRRKPNYSSVDLSEVEWEDRDDVLRNAMVNRKTGKFSMEVKKTVDKGKRVLVMTNDYYYTDIKGAPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKARDKENIFNADHFPLWYRRAAEQIPGSFVYSIPFSTGTVNKSNVVTASTSIQLLDERKSPVVAAVGIQMKLEFFQRKFWTASRQCASLDGKCSISCDDETVNCYLIDNNGFILVSEDYTQTGDFFGEVEGAVMNKLLTMGSFKRITLYDYQAMCRANKESSDSAHGLLDPYKAFLSAAKWIVTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGASSLQAQVALLLLPLVSSLFSR

SEQ ID NO: 3285 - protein, 949 aa, Mus musculus
MAASTGYVRLWAAARCWVLRRPLLAVTGGRVPSASGSWLRRGCRACDMSAPWGGRVLPGGVQWRGLWDSGNRGGSDETSEGGAEDGATASTGEGPVVTALAPMTVPDVFPHLPLIAITRNPVFPRFIKIVEVKNKKLVELLRRKVRLAQPYVGVFLKRDDNNESDVVESLDEIYHTGTFAQIHEMQDLGDKLRMIVTGHRRIHISRQLEVEPEGLEPEAEKQKSRRKLKRGKKEVEDELGPKPQLEMVTEAATDTSKEVLMVEVENVAHEDFQVTEEVKALTAEIVKTIRDIIALNPLYRESVLQMMQAGQRVVDNPIYLSDMGAALTGAESHELQDVLEETNILKRLYKALSLLKKEFELSKLQQRLGREVEEKIKQTHRKYLLQEQLKIIKKELGLEKDDKDAIEEKFRERLRELVVPKHVMDVVDEELSKLALLDNHSSEFNVTRNYLDWLTSIPWGRQSDENLDLARAQAVLEEDHYGMEDVKKRVLEFIAVSQLRGSTQGKILCFHGPPGVGKTSIARSIARALGREYFRFSVGGMTDVAEIKGHRRTYVGAMPGKIIQCLKKTKTENPLVLIDEVDKIGRGYQGDPSSALLELLDPEQNANFLDHYLDVPVDLSKVLFICTANVIDTIPEPLRDRMEMINVSGYVAQEKLAIAERYLVPQARTLCGLDESKAQLSAAVLTLLIKQYCRESGVRNLQKQVEKVLRKAAYKIVSGEAQTVQVTPENLQDFVGKPVFTVERMYEVTPPGVVMGLAWTAMGGSTLFVETSLRRPQPSGSKEDKDGSLEVTGQLGDVMKESARIAYTYARAFLMEQDPENDFLVTSHIHLHVPEGATPKDGPSAGCTIVTALLSLALGQPVLQNLAMTGEVSLTGKVLPVGGIKEKTIAAKRAGVTCIILPAENRKDYSDLAPFITEGLEVHFVEHYRDIFPIAFPRREHREALAVER

SEQ ID NO: 3286 - protein, 1224 aa, Mus musculus
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPSEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKIQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLSAATHGLDEEAESLKETFDPEKETIPDIDPNAKLLQPPAPIMPLDTNWPLLTVSKGFFEGSIASKGKGGALAADIDIDTVGTEGWGEDAELQLDEDGFVEAPEGLGEDVLGKGQEEGGGWDVEEDLELPPELDVPSGVSGSAEDGFFVPPTKGTSPTQIWCNNSQLPVDHILAGSFETAMRLLHDQVGVIQFGPYKQLFLQTYARGRTTYQALPCLPSMYSYPNRNWKDAGLKNGVPAVGLKLNDLIQRLQLCYQLTTVGKFEEAVEKFRSILLSVPLLVVDNKQEIAEAQQLITICREYIVGLCMEIERKKLPKETLDQQKRICEMAAYFTHSNLQPVHMILVLRTALNLFFKLKNFKTAATFARRLLELGPKPEVAQQTRKILSACEKNPTDACQLNYDMHNPFDICAASYRPIYRGKPVEKCPLSGACYSPEFKGQICRVTTVTEIGKDVIGLRISPLQFR

SEQ ID NO: 3287 - protein, 572 aa, Rattus norvegicus
MASAKTYVTKFKSFVILFFAPILLLPLIILVPDKFARCAYVIILMAIYWCTDVIPVAITSLLPVLLFPLLKVLDSKQVCVQYMTDTNMLFLGSLIVATAVERWELHKRIALRMLLFVGTKPSRLMLGFMFVTAFLSMWISNTATTAMMIPIVEAMLEQMVATNVAVDASQRTMELLDKNKASELPGSQVVFEDPSVQKQEDEETKNMYKAMNLCVCYAASIGGTATLTGTGPNVVLLGQMQELFPDSKDVMNFASWFAFALPNMLLMLVMAWLWLLCFYMRPNLKKTCICCGRKKKDTEKIASKVLYEEYRKLGPLSYAECNVLFCFGLLIILWFSRDPGFMPGWLSIAWIEGNTKHVTDATVAIFVAILLFIVPSQKPKFNFSRQTEEERKTPFYPPPLLNWKVTQEKVPWGIVLLLGGGFAMAKGCETSGLSEWMARQMEPLSSVRPAIITLILSCIVAMTTECTSNVATTTLFLPIFASMARSIGIHPLYVMIPCTLSASLAFMLPVATPPNAIVFAYGHLKVIDMVKTGLVMNILGIASVFLSVNTWGRAVFNLDKFPDWANLTHINT

SEQ ID NO: 3288 - protein, 245 aa, Streptococcus mutans
MKDIIVIKIGGVASQQLSGDFLSQIKNWQDAGKQLVIVHGGGFAINKLMEENQVPVKKINGLRVTSKDDMVLVSHALLDLVGKNLQEKLRQAGVSCQQLKSDIKHVVAADYLDKDTYGYVGDVTHINKRVIEEFLENRQIPILASLGYSKEGDMLNINADYLATAVAVALAADKLILMTNVKGVLENGAVLEKITSHQVQEKIDTAVITAGMIPKIESAAKTVAAGVGQVLIGDNLLTGTLITAD

SEQ ID NO: 3289 - protein, 451 aa, Streptococcus agalactiae
MKTITTFENKKVLVLGLARSGEAAARLLAKLGAIVTVNDGKPFDENPTAQSLLEEGIKVVCGSHPLELLDEDFCYMIKNPGIPYNNPMVKKALEKQIPVLTEVELAYLVSESQLIGITGSNGKTTTTTMIAEVLNAGGQRGLLAGNIGFPASEVVQAANDKDTLVMELSSFQLMGVKEFRPHIAVITNLMPTHLDYHGSFEDYVAAKWNIQNQMSSSDFLVLNFNQGISKELAKTTKATIVPFSTTEKVDGAYVQDKQLFYKGENIMSVDDIGVPGSHNVENALATIAVAKLAGISNQVIRETLSNFGGVKHRLQSLGKVHGISFYNDSKSTNILATQKALSGFDNTKVILIAGGLDRGNEFDELIPDITGLKHMVVLGESASRVKRAAQKAGVTYSDALDVRDAVHKAYEVAQQGDVILLSPANASWDMYKNFEVRGDEFIDTFESLRGE

SEQ ID NO: 3290 - protein, 148 aa, Brucella suis; identical to SEQ ID NO: 72

SEQ ID NO: 3291 - protein, 123 aa, Brucella suis; identical to SEQ ID NO: 73

SEQ ID NO: 3292 - protein, 179 aa, Platanus acerifolia
MKLSFSLCIFFFNLLLLLQAVISADIVQGTCKKVAQRSPNVNYDFCVKSLGADPKSHTADLQGLGVISANLAIQHGSKIQTFIGRILKSKVDPALKKYLNDCVGLYADAKSSVQEAIADFKSKDYASANVKMSAALDDSVTCEDGFKEKKGIVSPVTKENKDYVQLTAISLAITKLLGA

SEQ ID NO: 3293 - protein, 365 aa, Rosa chinensis
MGSTGETQMTPTQVSDEEANLFAMQLASASVLPMVLKAAIELDLLEIMAKAGPGAFLSPNDLASQLPTKNPEAPVMLDRMLRLLASYSILTYSLRTLPDGKVERLYGLGPVCKFLTKNEDGVSIAALCLMNQDKVLVESWYHLKDAVLDGGIPFNKAYGMTAFDYHGTDPRFNKVFNKGMADHSTITMKKILETYKGFEGLTSIVDVGGGTGAVVNMIVSKYPSIKGINFDLPHVIEDAPQYPGVQHVGGDMFVSVPKGDAIFMKWICHDWSDEHCLKFLKNCYAALPDNGKVILGECILPVAPDTSLATKGVVHIDVVMLAHNPGGKERTEQEFEALAKGSGFQGIRVACNAFNTYVIEFLKKI

SEQ ID NO: 3294 - protein, 484 aa, Arabidopsis thaliana
MDDCSKDIINCLPDNLLCQILSNLSTKEAALTSLLSKRWRYLFALVPNLDFDVLPSLHPEVAMQDQDQTSFIDFVDRVLKLRGKDHINKFSLKCGDGIEDEDVFPWILNTLRHGVSDLSLHVSPSLVYWLPSKVFASKTLVRLKIGPKDGPRVKLRNVCLPKLKTLNLDSVVFEEGKIGFAKLLSGCPVLEELSLLNLAWDRWDSCSVSSKILKRLTLYCAHSSRNPKSVSFDTPNVVYFEYSDNIANKYPKVNFDSLVEASIGIRMTKVQKANARYVSDVDEETEMVGNATDLLMGICNVKTLYLSYDTLETLNLCCQVIPVFNNLTHLTIESHPELGWESLPNLLKSCPNLGTLVFQGLLHKATDRCGDVCMCQGLENSHSCLSSSPVKCLKILKFGETNDDDDMEIEMEQIKNFLEKMPNLEQLIIYYESSIDNDLVRVSSQLQEVPTVASLKCKIQVISDNLSLSSTLPISLSMENGFHL

SEQ ID NO: 3295 - protein, 505 aa, Arabidopsis thaliana
MAALIQTIHGGVVVTRTLTLVYPSTFTSRHKALNQMTSSSNSGLRRFLFTPPQRLSQGICYWGAELSNNVSWTYKTKMVVRSKAGAVPLMKHGDRFLSSLSSPALAGDPSAINRHIKKFVAASPKSVALNVLSHLLSDQTSHPHLSFFALSLYSEITEASWFDWNPKLIAELIALLNKQERFDESETLLSTAVSRLKSNERDFTLFLCNLVESNSKQGSIQGFSEASFRLREIIQRSSSVYVKTQAYKSMVSGLCNMDQPHDAERVIEEMRMEKIKPGLFEYKSVLYGYGRLGLFDDMNRVVHRMGTEGHKIDTVCSNMVLSSYGAHDALPQMGSWLQKLKGFNVPFSIRTYNSVLNSCPTIISMLKDLDSCPVSLSELRTFLNEDEALLVHELTQSSVLDEAIEWNAVEGKLDLHGMHLSSSYLILLQWMDETRLRFSEEKCVIPAEIVVVSGSGKHSNVRGESPVKALVKKIMVRTGSPMRIDRKNVGSFIAKGKTVKEWLCK

SEQ ID NO: 3296 - protein, 504 aa, Arabidopsis thaliana
MAALIQTIHGVVVTRTLTLVYPSTFTSRHKALNQMTSSSNSGLRRFLFTPPQRLSQGICYWGAELSNNVSWTYKTKMVVRSKAGAVPLMKHGDRFLSSLSSPALAGDPSAINRHIKKFVAASPKSVALNVLSHLLSDQTSHPHLSFFALSLYSEITEASWFDWNPKLIAELIALLNKQERFDESETLLSTAVSRLKSNERDFTLFLCNLVESNSKQGSIQGFSEASFRLREIIQRSSSVYVKTQAYKSMVSGLCNMDQPHDAERVIEEMRMEKIKPGLFEYKSVLYGYGRLGLFDDMNRVVHRMGTEGHKIDTVCSNMVLSSYGAHDALPQMGSWLQKLKGFNVPFSIRTYNSVLNSCPTIISMLKDLDSCPVSLSELRTFLNEDEALLVHELTQSSVLDEAIEWNAVEGKLDLHGMHLSSSYLILLQWMDETRLRFSEEKCVIPAEIVVVSGSGKHSNVRGESPVKALVKKIMVRTGSPMRIDRKNVGSFIAKGKTVKEWLCK

SEQ ID NO: 3297 - protein, 449 aa, Arabidopsis thaliana
MDAKMFDTICSRDAISWLPDEVLGKILSLIPTKQAVSTSLLAKKWRTIFRLVDHLELDDSFSLQAVKDQTPGLRKHVRFVFTEDFKIFVDRTLALQCDYPIKNFSLKCHVSKYDERQKACVGRWISNVVGRGVFELDLRMKDPGIHFLPPHLVASKTLVKLTLGTQLCLGQLPSYVSLPSLKSLFIDTIVFYDIEDLCCVLLAGCPVLEELSVHHHDFIATPHTISSPTLKRLSVDYHCPDDVDSASHMSFDLPKLVYLEYSHCALGEYWQINLESLVEAKLDLGLERKVLRMDVTDLIIGIRNVQSLHLSPDSVHVIYSYCRHGLPVFKNLVNLSFGSKNKRGWRLLANLLKQSTKLETLIVKDLNGYTGDVSMPLNKVTSLHILGYRGTADEVKQLKSFIGEFECLELVQVDVAEAAEDNGKILQSKRDLMMLLGVSLPSKCQFKVT

SEQ ID NO: 3298 - protein, 185 aa, Arabidopsis thaliana
EVLGKILSLIPTKQAVSTSLLAKKWRTIFRLVDHLELDDSFSLQAVKDQTPGLRKHVRFVFTEDFKIFVDRTLALQCDYPIKNFSLKCHVSKYDERQKACVGRWISNVVGRGVFELDLRMKDPGIHFLPPHLVASKTLVKLTLGTQLCLGQLPSYVSLPSLKSLFIDTIVFYDIEDLCCVLLAGC

SEQ ID NO: 3299 - protein, 84 aa, Arabidopsis thaliana
QLVHLLIENKNKKLVVFFMTCACVDYWGLVLSKIPTLKSISFFSTHGKMDQKGRDTALASFTEASSGVLLCTDVAARGLDIPGI

SEQ ID NO: 3300 - protein, 44 aa, Arabidopsis thaliana
VHLLIENKNKKLVVFFMTCACVDYWGLVLSKIPTLKSISFFSTH

SEQ ID NO: 3301 - protein, 177 aa, Arabidopsis thaliana
VNYFFSKLPMHIGWRLMLGIAAVPSLVLAFGILKMPESPRWLIMQGRLKEGKEILELVSNSPEEAELRFQDIKAAAGIDPKCVDDVVKMEGKKTHGEGVWKELILRPTPAVRRVLLTALGIHFFQHASGIEAVLLYGPRIFKKAGITTKDKLFLVTIGVGIMKTTFIFTATLLLDKV

SEQ ID NO: 3302 - protein, 115 aa, Arabidopsis thaliana
CVDDVVKMEGKKTHGEGVWKELILRPTPAVRRVLLTALGIHFFQHASGIEAVLLYGPRIFKKAGITTKDKLFLVTIGVGIMKTTFIFTATLLLDKVGRRKLLLTSVGGMVIALTM

SEQ ID NO: 3303 - protein, 852 aa, Arabidopsis thaliana
MRDFVIVFGSSSAITNPHHHHRRCYATAPESNRKTKSNSSFTKLLPSLPQQHSPSPASVSATHSLSSHFSNVVRWIPDGSLEYYADFASKLAEDGRIEDVALIAETLAAESGANVARFASMVDYDLLSKGISSNLRQGKIESVVYTLKRIEKVGIAPLDLVDDSSVKLMRKQFRAMANSVQVEKAIDLMEILAGLGFKIKELVDPFDVVKSCVEISNPQLAIRYACLLPHTELLLCRIIHGFGKKGDMVSVMTAYEACKQILDTPNMYICRTMIDVCGLCGDYVKSRYIYEDLLKENIKPNIYVINSLMNVNSHDLGYTLKVYKNMQILDVTADMTSYNILLKTCCLAGRVDLAQDIYKEAKRMESSGLLKLDAFTYCTIIKVFADAKMWKWALKVKDDMKSVGVTPNTHTWSSLISACANAGLVEQANHLFEEMLASGCEPNSQCFNILLHACVEACQYDRAFRLFQSWKGSSVNESLYADDIVSKGRTSSPNILKNNGPGSLVNRNSNSPYIQASKRFCFKPTTATYNILLKACGTDYYRGKELMDEMKSLGLSPNQITWSTLIDMCGGSGDVEGAVRILRTMHSAGTRPDVVAYTTAIKICAENKCLKLAFSLFEEMRRYQIKPNWVTYNTLLKARSKYGSLLEVRQCLAIYQDMRNAGYKPNDHFLKELIEEWCEGVIQENGQSQDKISDQEGDNAGRPVSLLIEKVATHMQERTAGNLAIDLQGLTKIEARLVVLAVLRMIKEDYMRGDVVIDDVLIIIGTDEANTVSGKQEITVQEALVKLLRDELSLVVLPAGQRNIIQDAHCVDDADQENTKSFVSISSTRRPAILERLMVTKASLYQWLQRRK

SEQ ID NO: 3304 - protein, 221 aa, Lotus japonicus
MALPSVTALQVENVAFPPTLIKPPASANTLFLGGAGERGLHIQDKFVKFTAIGIYLQDTAVPSLAVKWKGKPVDELTESVQFFRDIVTGPFEKFMQVTMILPLTGQQYSEKVSENCVAIWKHLGIYTDEEGKAIDKFVSVFKDQTFPPGSSILFTVLPKGSLAISFSKDGSIPEVESAVIDNKLLSEAVLESMIGAHGVSPAAKQSLASRLSELFKHHAEV

SEQ ID NO: 3305 - protein, 329 aa, Spinacia oleracea
MAAKLMHAIQYSGYGGGTDALKHVEVAVPDPKSDELLLKIEAATLNPIDWKIQKGVLRPLLPRKFPTIPGTDVAGEVVQAGSAVNRFKTGDKVVAVLSHATGGALAEYAVAKENLTVARPPEVSAAEGAALPVAALTAHQALTQFANIKLDGSGERKNILITAASGGVGHYAVQLAKLGNTHVTATCGARNLDFVKGLGADEVLDYKTPEGASLTSPSGKKYDYVVHGASGIPWSTFEPNLSEAGKVIDLTPGPTAMMTFAWKKLTFSKKQLVPLLLIPKIPNFEYVVNLVKEKKLKTVIDSKHPLSKGEDAWSRIMGGHATGKIIIEP

SEQ ID NO: 3306 - protein, 571 aa, Arabidopsis thaliana
MKFMKLGSKPDTFESDGKFVKYAVSDLDSDVTIHVGEVTFHLHKFPLLSKSNRMQRLVFEASEEKTDEITILDMPGGYKAFEICAKFCYGMTVTLNAYNITAVRCAAEYLEMTEDADRGNLIYKIEVFLNSGIFRSWKDSIIVLQTTRSLLPWSEDLKLVGRCIDSVSAKILVNPETITWSYTFNRKLSGPDKIVEYHREKREENVIPKDWWVEDVCELEIDMFKRVISVVKSSGRMNNGVIAEALRYYVARWLPESMESLTSEASSNKDLVETVVFLLPKVNRAMSYSSCSFLLKLLKVSILVGADETVREDLVENVSLKLHEASVKDLLIHEVELVHRIVDQFMADEKRVSEDDRYKEFVLGNGILLSVGRLIDAYLALNSELTLSSFVELSELVPESARPIHDGLYKAIDTFMKEHPELTKSEKKRLCGLMDVRKLTNEASTHAAQNERLPLRVVVQVLYFEQLRANHSPVASVAASSHSPVEKTEENKGEEATKKVELSKKSRGSKSTRSGGGAQLMPSRSRRIFEKIWPGKGEISNKSSEVSSGSSQSPPAKSSSSSSRRRRHSIS

SEQ ID NO: 3307 - protein, 361 aa, Arabidopsis thaliana
MRKWICCTCQIEDSNEEQQLKSSQQQSDANHKNSKPAPVAKHEVKKEALPIEVPPLSLDEVKEKTENFGSKALIGEGSYGRVYYATLNDGVAVALKKLDVAPEAETDTEFLSQVSMVSRLKHENLIQLLGFCVDGNLRVLAYEFATMGSLHDILHGRKGVQGAQPGPTLDWITRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYEAEFRPNMSIVVKALQPLLKPPAAAPAPES

SEQ ID NO: 3308 - protein, 1043 aa, Oryza sativa
MEFDRRKAAALAALASPAPDKSPKGGVDAPIAPLLDALNSHPDLFTTSSCSGRVSVLAQPPPPQQADPGGAKTKKKARGGGWVYISHDPADPEALVEVLFGVKEGGGGGDDELVFRFEPMIVAVECRDAAAAAALVAAAVGAGFRESGITSLQKRVMVALRCSIRMEVPLGQTKELVVSPDYIRYLVRIANSKMEANKKRMGGFLDLLQAKISLEASYLESQDPVLQNGAKHGFGNAKRHVLISLSFYPAFISPHGVILTQEEALPTLSGNTTHCLSTAALEITGEPIEKLFLWGQSACALTVGREHHILTFGGFGGPGRHARRNYSLLVNPGSGLLTELKVTGSPSPRMGHTITVVGNDIYVVGGRSGPSEILNDIWVLERSNNRWSKVDCSGDFFRPRHRHAAAAVDRKVYVFGGLSDDGLCSCMNIMDTASIQWNVISPDDKWPCARHSHSLVSYGSKLFLFGGHDGQRALNDFYSFDTTTLKWNKENTNGKAPSPRFSHCMFIYKDYLGILGGCPIRESSQEIALLNLKHKIWFYVSIPSLSQCLCVRSSSVIIDDDLVIVGGGASCYAFGTRFSQPIKIDLHLLESIFKLAYNKEKEMSVQHGSVSNVDLLEGHEENCNPSDNVKVVIDTATLGSSPLVLQLEKKYAKLAKDILKKFGWLDLTRKVRVSQDNIHVLFPVSKTFHALITDKHLKVQPDDSCVFEELLPFSENKLFGASISLQKALEILLLCRGSILKDEVAISRKASKTPQTIMRELVSVLLDKKGLPSQLLEQLPTRWETLGDIIVLPKTCFKDPLWESVRDDLWPLVAKSLGAQRLARQGKITPNGTRDSTLELLVGNDGWLTHHENGICYSLDATKCMFSSGNRSEKLRMGKLDCRDEVVVDLFAGIGYFVLPFLVKANAKLVYACEWNPHALEALQRNVMDNHVADRCIILEGDNRLTAPKGIADRVCLGLLPSSECSWDTAVRALRAEGGMLHIHGNVNDSDESLWLDNVVKSITNIAKTHGLSWNVTVEHVERVKWYGPHIRHLVVDVKCRAT

SEQ ID NO: 3309 - protein, 351 aa, Coptis japonica
MDTPNTFQNDDEIKAQAQVWKHMFGFAETIMLRSTVSLGIPDIIHNNGPVTLSQLVTHLPLKSTSIDRFHHFMRYLVHMQLFTISTDQITKEDKYELTPASKLLVHGHQKSLAPYVMLQTHPEEFSVWSHVINVLDGKKPYWESNDTSMYEKTEGDPEINEILNDAMTSHSTFMLPALVSGLMKENVLDGVASIVDVGGNSGVVAKGIVDAFPHVKCSVMDLNHVIERVIKNPKLDYVAGDMFTSIPNADAILLKSTLHNYEDDDCIKILNIAKEALPSTGGKVILVEIVVDTENLPLFTSARLSMGMDMMLMSGKERTKKEWEDLLRKANFTSHQVIPIMAIESIIVAYS

SEQ ID NO: 3310 - protein, 112 aa, Bos taurus
KVLYKTFGPYFLMSFLFKAVHDLMMFAGPEILKLLINFVNDKKAPEWQGYFYTALLFISACLQTLVLHQYFHICFVSGMRIKTAVIGAVYRKALVITNAARKSSTVGEIVNL

SEQ ID NO: 3311 - protein, 98 aa, Bos taurus
KAVHDLMMFAGPEILKLLINFVNDKKAPEWQGYFYTALLFISACLQTLVLHQYFHICFVSGMRIKTAVIGAVYRKALVITNAARKSSTVGEIVNLMSV

SEQ ID NO: 3312 - protein, 423 aa, Macaca fascicularis
MAAPRVFPLSCAVQQYAWGKMGYNSEVARLLASSDPLAQIAEDKPYAELWMGTHPRGDAKIFDNGISQKTLGQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASALQSCFSHLMKSEKKVVAEQLNLLVKRISQQVAAGNNMEDIFGELLLQLHQQYPGDIGCFAIYFLNLLNLKPGEAMFLEANVPHAYLKGDCVECMACSDNTVRAGLTPKFIDVPTLCEMLSYTPSSSKDRLFLPTRSQEDPYLSIYDPPVPDFAIMKMEVPGSVTEYKVLALDSASILLVVQGTVIASTPTTQTPIPLQRGGVLFIGANESVSLKLTEPKDLLIFRACCLL

SEQ ID NO: 3313 - protein, 333 aa, Macaca fascicularis
MFRAAAPGQLRRAASSLRFQSTLVIAEHANDSLAPITLNTITAATRLGGEVSCLVAGTKCDKVAQDLCKVAGIAKVLVAQHDAYRGLLAEDLTPLILATQKQFNYTHICAGASAFGKNLLPRVAAKLEVAPISDIIAIKSPDTFVRTIYAGNALCTVKCDEKVKVFSVRGTSFEAAATSGGTASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 3314 - protein, 325 aa, Macaca fascicularis
MAAMTKALPRRLVGLASLRAVSTSSMDTLPKQVKIVEVGPRDGLQNEKNIVSTPVKIKLIDMLSEAGLSVIEATSFVSPKWVPQMADHAEVLKGIQKFPGITYPVLIPNLKGFEAAVAAGAKEVSIFGAASELFTKKNVNCSIEESFQRFDAILKAAQSANISVRGYVSCVLGCPYEGKISPAKVAEVTKKFYSMGCYEISLGDTIGVGTPGIMKDMLSAVMQEVPPAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 3315 - protein, 319 aa, Bos taurus
MLFWLLVLLILCGFLWNYKRQLKIANITDKYIFITGCDTGFGNLAARTFDKKGFHVIAACLTESGSTALKAETSERLHTVLLDVTDPENVKRAAQWVKNQVGEKGLWGLINNAGILGVLAPNDWLTVEDYREPVEVNLFGLISVTLNMLPLVKKARGRIINVSSIGGRLAFGGGGYSPSKYAVEGFNDSLRRDMKAFGVHVACIEPGLFKTNLSDPEKTAEKKLAIWKHLSPDIKQQYGESYIEKSLEQLKGTASFVNVDLSLVVECMDHALTSLFPKTRYAAGKDAKTFWIPLSHMPAVLQDFLLLKQKVELANPRAV

SEQ ID NO: 3316 - protein, 99 aa, Felis catus
MMSLKLLLLVMLLLGASLQVTHAARATNVGRECCLEYFKGAIPLRRLTGWYRTSGECSKDAIVFVTIHGKSICSDPKDTRVKKTVRYLQSIMNPVPQES

SEQ ID NO: 3317 - protein, 42 aa, Plasmodium falciparum
MAKRIFSVSFLLVLLNVLHICIKFSVADLPTHVETKNLLGKW

SEQ ID NO: 3318 - protein, 68 aa, Plasmodium falciparum
MAKRIFSVSFLLVLLNVLHICIKFSVADLPTHVETKNLLGKWKILRTKTSPNLTTCGSSQPNKNTYNV

SEQ ID NO: 3319 - protein, 147 aa, Danio rerio
LFTPLLIGFVAAAVILVLILIVLTYKYMQKPKYQIQWKVIEGIHGNNYVYIDPTQLPYDHQWEFPRDKLRFGKTLGSGAFGKVVEATAYGMSKADTVMTVAVKMLKPSAHATEKEALMSELKVLSYLGNHINIVNLLGACTVGGPTL

SEQ ID NO: 3320 - protein, 141 aa, Danio rerio
AAAVILVLILIVLTYKYMQKPKYQIQWKVIEGIHGNNYVYIDPTQLPYDHQWEFPRDKLRFGKTLGSGAFGKVVEATAYGMSKADTVMTVAVKMLKPSAHATEKEALMSELKVLSYLGNHINIVNLLGACTVGGPTLVITE

SEQ ID NO: 3321 - protein, 364 aa, Danio rerio
MTHQFPALSTEQKKELATIAERIVAPGKGILAADESTGTMAKRFQKINVENTEENRRSFRDLLFSVDDSISESIGGVILFHETLYQKSDKGVLFPKVIKDKGIVVGIKVDKGTAGLAGTDGETTTQGLDGLSERCAQYKKDGCDFAKWRCVLKISDSCPSALGIAENANVLARYASICQQNGLVPIVEPEILPDGDHDLKQCQYATEKVLAAVYKALSDHHVYLEGTLLKPNMVTAGHSCTKKYTPLEVAMATVTALRRTVPAAVPGICFLSGGQSEEEASLNLNAMNQLSLHRPWKLSFSYGRALQASALSAWKGQAANKKASQDAFVTRAKINSLASKGEYKPSGQAGQASTQSLFTASYTY

SEQ ID NO: 3322 - protein, 345 aa, Mus musculus
MAASGKLGTFRLPPLPTIREIIKLFGLRAVKQLSQNFLLDLRLTDKIVRKAGSLADVYVYEVGPGPGGITRSILNANVAELLVVEKDTRFIPGLQMLSDAAPGKLRIVHGDVLTYKIEKAFPGNIRRQWEDDPPNVHIIGNLPFSVSTPLIIKWLENISLKDGPFVYGRTKMTLTFQKEVAERLVATTGSKQHSRLSIMAQYLCNVEHLFTIPGKAFVPKPKVDVGVVHLTPLIEPKIKQPFKLVEKVVQNAFQFRRKYCHRGLGMLFPEAQRLESTGRLLQLADIDPTLRPTHLSLMHFKSLCDVYRKMCDEDPQLFTYNFREELKQKKSKGQEKDGDPESCGF

SEQ ID NO: 3323 - protein, 366 aa, Mus musculus
MVRCGCALLRKYGNFIDNLRIFTKGGSGGMGYPRLGGEGGRGGDVWVVAHKNMTLKQLKNKYPQKRFVAGGGANSRVSALQGSKGKDCEVPAPVGISVTDENGQVLGELNKEEDRVLVAKGGLGGKLHTNFLPLKGQKRIVHLDLKVIADVGLVGFPNAGKSSLLSRVSHATPVIADYAFTTLRPELGKIMYNDFKQISVADLPGLIEGAHMNKGMGHKFLKHLERTRQLLFVVDISGFQLSSVTPYRTAFETIILLTKELELYKEELQTKPALLAINKMDLPDAQVKLQELMKQLLSPEDFLHLFETKMIPEKALEFQHIVPISTVTGEGIAELKSCIRKALDEQDGKESDAHRSKQLLNLQSSS

SEQ ID NO: 3324 - protein, 209 aa, Mus musculus
MKKLKLKELESRLQEVDGFEKPKLLLEQYPTRPHIAACMLYTIHNTYDDIENKAVADLGCGCGVLSIGAAMLGAGLCVGFDIDEDALEIFNKNVEEFELTNVDMIQCDVYSLSNRMSKLFDTVIMNPPFGTKNNKGTDMAFLKTALGMARTAVYSLHKSSTREHIQKKAAEWKVKIEIIAELRYDLPALYNFHKKKSVDIEVDLIRFSF

SEQ ID NO: 3325 - protein, 1086 aa, Mus musculus
MLEADLVSKMLRAVLQSHKNGIVLPRLQGEYRSLTGDWIPFKQLGYPTLEAYLRSVPAVVRIEASRSGEIVCYAVACTETARIAQLVARQRTSKRKIGRQINCQMRVKKAMPFFLEGKPKATLRQPGFASDYSISRKPNSALLRDRGSALGVKADVDMPPYPDTPVQRHASMSANSRFSPKSSLPASFQTHISRACPTEVNDNLNQTVEKPNITPPASYTNKMDEVQNRIKEILDKHNNGIWISKLPHFYKEFYKEDLNQGVLQQFEHWPHICTVEKPCGGGQDSLLYPARREQPLKSDQDPEKELPPPPPAPKQEVPSQGSPAVMPDVKEKVAELLGKYSSGLWASALPKAFEDMYKVKFPEDALKNLASLSDVCTINYISGNTQKAILYAKLPLPTDKILKDEGQAQGDFDIKSMIEQEYLQIEKNMAESADEFLEDITVPPLVIPTEASPSVLVVELSNTNDVVIRYVGKDYSAAQELMEDEMKEFYSKNPRVTPIQTVHVGQLLAVNAEEDAWLRAQIISTDENKIKVCYVDYGFCENIEKSKAYRLNPRFCSLSFQATKCKLAGLEVLNDDPDLVKAVESLTCGKIFAVEILDKSDVPLVVLYDTSGEDDININATCLKAICDRSLQVHLQVDAMYTNVKVTNICSDGTLYCQVPCKGLNKLNDLLHKTEDYFHCKHMTSEYFISLPFCGKICLFHCKGKWLRVEITNVHSSRALDVQFLDSGNSTSVKVSELREIPPRFLQEMLAIPPQAIKCCLADLPQSIGMWTPDAVLWLRDSVLNCSDCSIKVTKMDETKGVAYVYLFTPNNFPDPHRSINRQITNADLWKHQKDVFLSAVSTAASSPGNRNGGTPAPGSPAESLRKSHPEVIKKSVLDHTSSFSLEELPPPVHLSRSGEHMDVYVPVACHPGHFVIQPWQEIHKLEVLMEEMILYYSVSEERHIAVERDQVYAAKVENKWYRVLLKGILTNGLVSVYELDYGKHELVNIRKVQPLVDVFRKLPFQAVTAQLAGVKCSQWSEEASMVFRNHVEKKALVALVQTVVEHTNPWDRKVVLYLVDTSLPDTDTWIHDFMSQYLLELSKVN

SEQ ID NO: 3326 - protein, 131 aa, Mus musculus
LVKAVESLTCGKIFAVEILDKSDVPLVVLYDTSGEDDININATCLKAICDRSLQVHLQVDAMYTNVKVTNICSDGTLYCQVPCKGLNKLNDLLHKTEDYFHCKHMTSEYFISLPFCGKICLFHCKGKWLRV

SEQ ID NO: 3327 - protein, 198 aa, Mus musculus
LVKAVESLTCGKIFAVEILDKSDVPLVVLYDTSGEDDININATCLKAICDRSLQVHLQVDAMYTNVKVTNICSDGTLYCQVPCKGLNKLNDLLHKTEDYFHCKHMTSEYFISLPFCGKICLFHCKGKWLRVEITNVHSSRALDVQFLDSGNSTSVKVSELREIPPRFLQEMLAIPPQAIKCCLADLPQSIGMWTPDAV

SEQ ID NO: 3328 - protein, 90 aa, Mus musculus
MKSLLLTILLLGLVAVLKAQEAPPDDLVDYSGIWYAKAMVHNGTLPSHKIPSIVFPVRIIALEEGDLETTVVFWNNGHCREFKFVMKKTE

SEQ ID NO: 3329 - protein, 96 aa, Mus musculus
MKSLLLTILLLGLVAVLKAQEAPPDDLVDYSGIWYAKAMVHNGTLPSHKIPSIVFPVRIIALEEGDLETTVVFWNNGHCREFKFVMKKTEEPGKYT

SEQ ID NO: 3330 - protein, 42 aa, Rattus norvegicus
PYVHLMKYVEDKFKEIKETWVLLVCIGATSGLGRLVSGHISD

SEQ ID NO: 3331 - protein, 29 aa, Rattus norvegicus
HLMKYVEDKFKEIKETWVLLVCIGATSGL

SEQ ID NO: 3332 - protein, 69 aa, Mus musculus
ITPLWIVTAAHCVYDLYHPKSWTVQVGLVSLMDSPVPSHLVEKIIYHSKYKPKRLGNDIALMKLSEPLT

SEQ ID NO: 3333 - protein, 54 aa, Mus musculus
WTVQVGLVSLMDSPVPSHLVEKIIYHSKYKPKRLGNDIALMKLSEPLTFDETIQ

SEQ ID NO: 3334 - protein, 69 aa, Mus musculus; identical to SEQ ID NO: 3332

SEQ ID NO: 3335 - protein, 54 aa, Mus musculus; identical to SEQ ID NO: 3333

SEQ ID NO: 3336 - protein, 117 aa, Mus musculus
KNTGKAVLACGGVWVMTLTTTVPLLLLYEDPDKASSPATCLKISDITHLKAVNVLNFTRLIFFFLIPLFIMIGCYVVIIHSLLRGQTSKLKPKVKEKSIRIIMTLLLQVLVCFVPFH

SEQ ID NO: 3337 - protein, 93 aa, Mus musculus
CHILGALVVFYPSLALWLLAFISADRYMAIVQPKYAKELKNTGKAVLACGGVWVMTLTTTVPLLLLYEDPDKASSPATCLKISDITHLKAVNV

SEQ ID NO: 3338 - protein, 456 aa, Mus musculus
MFLLLPFDSLIVNLLGISLTVLFTLLLVFIIVPAIFGVSFGIRKLYMKTLLKIFAWATLRMERGAKERNHQLYKPYTNGIIAKDPTSLEEEIKEIRRSGSSKALDKTPEFELSDIFYFCRKGMETIMDDEVTKRFSAEELESWNLLSRTNYNFQYISLRLTILWGLGVLIRYCFLLPLRIALAFTGIGLLVVGTTMVGYLPNGRFKEFLSKHVHLMCYRICVRALTAIITYHNRKNRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREKDEDAVQFANRVKSAIARQGGLVDLLWDGGLKREKVKDTFKEEQQKLYSKMIVGNHEDRSRS

SEQ ID NO: 3339 - protein, 98 aa, Mus musculus
TSKICKEYSQEDASFCKSLMNLFFSLHVLYKSPVTLLRDLSQDIHGQLGDIDQDVEIEKTDHFAVVNLRTAAPTVCLLVLSQAEKVLEEVDWLIAKIK

SEQ ID NO: 3340 - protein, 107 aa, Mus musculus
VFDLLKTSVVKSFKDLQLLQGSKFLQTLVPQRTCVSTMILEVVRNSVHSWDHVTQGLIEFGFILMDSYGPKKILDGKAVEIGTSLSKMTNQHACKLGANILLETFKI

SEQ ID NO: 3341 - protein, 114 aa, Mus musculus
EEQVFDLLKTSVVKSFKDLQLLQGSKFLQTLVPQRTCVSTMILEVVRNSVHSWDHVTQGLIEFGFILMDSYGPKKILDGKAVEIGTSLSKMTNQHACKLGANILLETFKIHEMI

SEQ ID NO: 3342 - protein, 107 aa, Mus musculus; identical to SEQ ID NO: 3340

SEQ ID NO: 3343 - protein, 112 aa, Mus musculus
LAVSPRFLGPDNNPLVVLNLSEPYPTMELQAIVPEVLKKIVTTYDMMMQSLKALIENADAVYEKIVHCQKAAMEFHEHLHSIGTKEGLKERKLQKAVESFTWNITILKGQAD

SEQ ID NO: 3344 - protein, 1624 aa, Mus musculus
MKELSVHVRQQTRALLHKILLKKWRRKRESLLEWSIPIIIGLHMGLFSYLARNIQVLEVPPQDLGSLNEFNGSSLVVVYTPISNITQQIMNKTTFAPTMKGTRIIGVPSIEDLDEVLLHNIPDALGVIFNDSFSYQLKVLRMYGNPFLKEDLLAHCWDTHSQAFCSLSKYWERGFVALQTAINAGIIEVTTNHSVMEELMSIDGINMKTLPFIPRDLSDYEIFILFCLLYFSSFIYFASSNVTKERKQCKEVMKVMGLQDSAFWLSWGLIYVGFIFIISIFIAIIITSTQIIMMTGFLVIFTLFFLYGLSLIAVTFLMAVLLQKAVLTNLIVLFFTLFWGCVGFTVLHKELPPSLEWVLSIFSPFAFTSGMAKVIFQDYNLNGVVFPDPSGESYVMIAVFFILAFDSLLYLVLALYFDKILLYGAEHRSAPLFFLNPTSCFRKTANRNKVIERDLDPELPSDEYFEPVDPEYQGKEAIRIRNIKKEYKGKSGKVKALKGLFLDIYESQITAILGHSGAGKSSLLNILSGLYVPTAGSVTVYNKNLSDMQDLKEIRKAIGVCPQHNVQFDALTVKENLTLFAKIKGILPQDVEQEVQQILSELDMQNIRDDLAEHLSEGQKRKLTFGIATVGDPQILLLDEPTVGLDPFSRQRIWGFLKERRADHVILFSTQFMDEADILADRKVLIANGALKCTGSSVFLKRKWGLGYHLSLFMDETCDSERLTSFINHHIPYAKLKAKTKEKLVYILPLERTSEFPEFFSDLDKYSGQGLMSYEVSMSTLNDVFLNLEGEPSTKQDFEKRETATDSESLNDMEVAYPSLSQVQETVSTMSLWRMQVCAIARLRILKLKRERKAFLIILLLLGIALLPLVIEYVANALLEVKNNWEFKTDLYFLSPGQLPQGLRTSLLVINNTESNIEDFLQSLKHQNIVLEVDDFENRNATNSLSYNGAIIVSGRQKDYRFSAVCNTKRLHCFPILMNVISNGILHMLNHTQYIRIKEDIFSPFIVLVWTGIQETCLFILCVICSLSPHIAMSSVSDYKKKADSQLWISGLYPSAYWCGQAVVDISLFSGMLLTSYFTSYTSKLLNIDMTSEIVFSVIVLALGCAASLVFLTYVISFVFGKRKKNSTLWSICFLLVIAITFEKVANGPFNEALVISATMLVPSFALNGLLVVLEMRAYQYYIEFEEIKHGLSAVDLLLCLIPYIHTLLFIFVLRCLELKYGKNVVRRDPIFRIAPQSLKAQPNPEEPIDEDENVQAERLRTSDALSTPNLDEKPVIIASCLHKEYAGQKKHCCSRRTRNMAVRNVSFCVNKGEILGLLGPDGAGKSSSIRMIAGITKPTAGQVELKRLSSAVGHQGDSRAEFGYCPQENGLWPNLTVKEHLELYAAVKGLRKEDAVVAISRLVNALKLHDQLNVQVQNLVAGATRKLCFVLSILGNSPVLILDEPSTGLDVSGKHQVWQAIQAVVKDNEKGVLLSTHDLAEAEALCDRAAIMVSGRLRCIGPIQHLKRKFGQDYVLELRVKDVSQEPLVHREILKLFPQAARQDRCFSLLTYKLPVTDVHPLSQAFHKLEAVKHGFDLEDYSLSQCTLDRVILELSKEQELGTVYEEADMTLGRKLLPPSDEL

SEQ ID NO: 3345 - protein, 1642 aa, Mus musculus
MATAIRDVGVWRQTRTLLLKNYLIKCRTKKSSVQEILFPLFFLFWLILVSMMHPNKKYEEVSDIELSPMDKFSLSNVILGYTPVTNITSSIMQRVSTDHLPKVIVTEEYANEKELVAASLSKSSNFVGVVFKDTMSYELRFFPEMIPVSSIYMNSREGCSKTCDAAQYWSLGFTVLQASIDAAIIQLKTNVSVWSELESTKAVIMGEAAVVEIDTFPRGVILIYLVIAFSPFGYFLAIHIVAEKEKKLKEFLKIMGLHDTAFWLSWVLLYASLIFLMSLLMAVIATASSLFPQSSSIVIFLLFFLYGLSSVFFALMLTPLFKKSKHVGVVEFFVTVVFGFVGLLIVLIESFPRSLVWLFSPLCQCAFLIGIAQVMHLEDFNEGALFSNLTEGPYPLIITIIMLALDSVFYVLLAVYLDQVIPGEFGLRRSSLYFLKPSYWSKNKRNYKELSEGNINGNISLNEIVEPVSSEFIGKEAIRISGIQKSYRKKTENVEALRNLSFDIYEGQITALLGHSGTGKSTLMNILCGLCPPSDGFASIYGHRVSEIDEMFEARKMIGICPQSDINFDVLTVEENLSILASIKGIPANNIIQEVQKVLLDLDMQAIKDNQAKKLSGGQKRKLSVGIAVLGNPKILLLDEPTAGMDPCSRHIVWNLLKYRKANRVTVFSTHFMDEADILADRKAVISQGMLKCVGSSIFLKSKWGIGYRLSMYIDRYCATESLSSLVRQHIPAAALLQQNDQQLVYSLPFKDMDKFSGLFSALDIHSNLGVISYGVSMTTLEDVFLKLEVEAEIDQADYSVFTQQPREEETDSKSFDEMEQSLLILSETKASSVSTMSLWKQQVSTIAKFHFLSLKRESKSVRAVLLLLLIFFAVQIFMFFLHHSFKNAVVPIKLVPDLYFLKPGDKPHKYKTSLLLQNSTDSDINGLIEFFAHQNIMVAMFNDSDYVSAAPHSAALNVVRSEKDYVFSAVFNSTMVYCLPVMMNIISNYYLYHLNVTEAIQTWSTPFIQEITDIVFKIELYFQAALLGIIVTAMPPYFAMENAENHKIKAYTQLKLSGLLPSAYWVGQAVVDIPLFFVVLILMLGSLFAFHHGLYFYPAKFLAVVFCLIAYVPSVILFTYIASFTFKKILNTKEFWSFIYSVTALACVAITETTFFLQYAVTAVFHYTFCIAIPIYPLLGCLISFIKGSWKNMPKNENTYNPWDRLLVAVIMPYLQCILWIFLLQHYEKIHGGRSIRKDPFFRALSQKAKNKKFPEPPINEDEDEDVKAERLKVKELMGCQCCEEKPAIMVCNLHKEYDDKKDFLHSRKTTKVATKYISFCVKKGEILGLLGPNGAGKSTVINTLVGDVEPTSGKIFLGDYGSHSSEDDESIKCMGYCPQTNPLWPDLTLQEHFEIYGAVKGMSPGDMKEVISRITKALDLKEHLQKTVKKLPAGIKRKLCFALSMLGNPQVTLLDEPSTGMDPRAKQHMWRAIRTAFKNKKRAALLTTHYMEEAEAVCDRVAIMVSGQLRCIGTVQHLKSKFGKGYFLEIKLKDWIENLEIDRLQREIQYIFPNASRQESFSSILAFKIPKEDVQSLSQSFAKLEEAKRTFAIEEYSFSQATLEQVFVELTKEQEEEDNSCGTLASTLWWERTQEDRVVF

SEQ ID NO: 3346 - protein, 220 aa, Mus musculus
MHSLNQKIKAFSRDNLRKQCTRVTTLTGKKLIETWEDATVHVVETEPSGGGGCGYVQDLTLDLQVGVIKPWLLLGSQDAAHDLELLRKHKVTHILNVAYGVENAFLSEFTYKTISILDVPETNILSYFPECFEFIEQAKLKDGVVLVHCNAGVSRAAAIVIGFLMSSEEATFTTALSLVKEARPSICPNPGFMEQLRTYQVGKESNGGDKVPAEDTTHGL

SEQ ID NO: 3347 - protein, 378 aa, Mus musculus
MDLIGLLKSQFLCHLVFCYVFIASGLIVNAIQLCTLVIWPINKQLFRKINARLCYCVSSQLVMLLEWWSGTECTIYTDPKACPHYGKENAIVVLNHKFEIDFLCGWSLAERLGILGNSKVLAKKELAYVPIIGWMWYFVEMIFCTRKWEQDRQTVAKSLLHLRDYPEKYLFLIHCEGTRFTEKKHQISMQVAQAKGLPSLKHHLLPRTKGFAITVKCLRDVVPAVYDCTLNFRNNENPTLLGVLNGKKYHADCYVRRIPMEDIPEDEDKCSAWLHKLYQEKDAFQEEYYRTGVFPETPWVPPRRPWSLVNWLFWASLLLYPFFQFLVSMVSSGSSVTLASLVLIFCMASMGVRWMIGVTEIDKGSAYGNIDNKRKQTD

SEQ ID NO: 3348 - protein, 139 aa, Rattus norvegicus
MMARLWKTTWFLLAILVALVAFSYQVKRKTFIRVEEVNALESSVKETLEYVTEEYNKKSEDLYNFRILRILKIEKQMTNHMEFHITVEMQRTTCLKTEKNLCNVQEGELHKQIQCYFSVYVIPWLEVFKMLKKNCTNSS

SEQ ID NO: 3349 - protein, 90 aa, Oryza sativa
IKSFLYQLCKGVAHCHGHGVLHRDLKPQNLLVDKEKGILKIADLGLGRAFTVPMKSYTHEIVTLWYRAPEVLLGSTHYSTGVDIWSVGCI

SEQ ID NO: 3350 - protein, 70 aa, Oryza sativa
LKPQNLLVDKEKGILKIADLGLGRAFTVPMKSYTHEIVTLWYRAPEVLLGSTHYSTGVDIWSVGCIFAEM

SEQ ID NO: 3351 - protein, 40 aa, Arabidopsis thaliana
YSTRQIITALLRKCCYKVVAVSDGLAAWEVLKEKSHNIDL

SEQ ID NO: 3352 - protein, 1219 aa, Arabidopsis thaliana
MANLQVSGILEKFQMTGKDKDYRYMATSDLLNELNKDSFKIDLDLEVRLSSIILQQLDDVAGDVSGLAVKCLAPLVKKVGEERIVEMTNKLCDKLLHGKDQHRDTASIALRTVVAQIAPTLAPSILVTLTPQMIGGISGQGMSSGIKCECLEIMCDVVQKYGSLMTDDHEKLLNTLLLQLGCNQATVRKKTVTCIASLASSLSDDLLAKATVEVVKNLSNRNAKSEITRTNIQMIGALCRAVGYRFGTHLGNTVPVLINYCTSASENDEELREYSLQALESFLLRCPRDISPYCDEILNLTLEYISYDPNFTDNMEEDTDNETLEDEEDDESANEYTDDEDASWKVRRAAAKCLAGLIVSRSEMLTKVYQEACPKLIDRFKEREENVKMDVFNTFIDLLRQTGNVTKGQTDTDESSPKWLLKQEVSKIVKSINRQLREKSVKTKVGAFSVLRELVVVLPDCLADHIGSLVPGIERALNDKSSTSNLKIEALVFTKLVLASHAPPVFHPYIKALSSPVLAAVGERYYKVTAEALRVCGELVRVVRPSTAGMGFDFKPFVHPIYNAIMSRLTNQDQDQEVKECAITCMGLVISTFGDQLRAELPSCLPVLVDRMGNEITRLTAVKAFSVIATSPLHINLSCVLDHLIAELTGFLRKANRVLRQATLITMNTLVTAYGDKIGSEAYEVILVELSSLISVSDLHMTALALELCCTLMTGKSCSENISLAVRNKVLPQALTLVKSPLLQGQALLDLQKFFEALVYHANTSFYTLLESLLSCAKPSPQSGGVPKQALYSIAQCVAVLCLAAGDKNCSSTVKMLMEILKDDSGTNSAKQHLALLSLGEIGRRKDLSAHAGIETIVIESFQSPFEEIKSAASYALGNIAVGNLSNYLPFILDQIDNQQKKQYILLHSLKEVIVRQSVDKADFQNSSVEKILALLFNHCESEEEGVRNVVAECLGKMALIEPEKLVPALQVRTTSPAAFTRATVVTAVKYSVVERPEKLDEIIFPQISSFLMLIKDGDRHVRRAAVSALSTFAHYKPNLIKGLLPELLPLLYDQTVIKKELIRTVDLGPFKHVVDDGLELRKAAFECVFTLVDSCLDQVNPSSFIVPFLKSGLEDHYDLKMLCHLILSLLADKCPSAVLAVLDSLVEPLHKTISFKPKQDAVKQEHDRNEDMIRSALRAISSLDRINGVDYSHKFKGLMGDMKRSVPLWEKFQTIRNE

SEQ ID NO: 3353 - protein, 1217 aa, Arabidopsis thaliana
MANLQVSGILEKMTGKDKDYRYMATSDLLNELNKDSFKIDLDLEVRLSSIILQQLDDVAGDVSGLAVKCLAPLVKKVGEERIVEMTNKLCDKLLHGKDQHRDTASIALRTVVAQIAPTLAPSILVTLTPQMIGGISGQGMSSGIKCECLEIMCDVVQKYGSLMTDDHEKLLNTLLLQLGCNQATVRKKTVTCIASLASSLSDDLLAKATVEVVKNLSNRNAKSEITRTNIQMIGALCRAVGYRFGTHLGNTVPVLINYCTSASENDEELREYSLQALESFLLRCPRDISPYCDEILNLTLEYISYDPNFTDNMEEDTDNETLEDEEDDESANEYTDDEDASWKVRRAAAKCLAGLIVSRSEMLTKVYQEACPKLIDRFKEREENVKMDVFNTFIDLLRQTGNVTKGQTDTDESSPKWLLKQEVSKIVKSINRQLREKSVKTKVGAFSVLRELVVVLPDCLADHIGSLVPGIERALNDKSSTSNLKIEALVFTKLVLASHAPPVFHPYIKALSSPVLAAVGERYYKVTAEALRVCGELVRVVRPSTAGMGFDFKPFVHPIYNAIMSRLTNQDQDQEVKECAITCMGLVISTFGDQLRAELPSCLPVLVDRMGNEITRLTAVKAFSVIATSPLHINLSCVLDHLIAELTGFLRKANRVLRQATLITMNTLVTAYGDKIGSEAYEVILVELSSLISVSDLHMTALALELCCTLMTGKSCSENISLAVRNKVLPQALTLVKSPLLQGQALLDLQKFFEALVYHANTSFYTLLESLLSCAKPSPQSGGVPKQALYSIAQCVAVLCLAAGDKNCSSTVKMLMEILKDDSGTNSAKQHLALLSLGEIGRRKDLSAHAGIETIVIESFQSPFEEIKSAASYALGNIAVGNLSNYLPFILDQIDNQQKKQYILLHSLKEVIVRQSVDKADFQNSSVEKILALLFNHCESEEEGVRNVVAECLGKMALIEPEKLVPALQVRTTSPAAFTRATVVTAVKYSVVERPEKLDEIIFPQISSFLMLIKDGDRHVRRAAVSALSTFAHYKPNLIKGLLPELLPLLYDQTVIKKELIRTVDLGPFKHVVDDGLELRKAAFECVFTLVDSCLDQVNPSSFIVPFLKSGLEDHYDLKMLCHLILSLLADKCPSAVLAVLDSLVEPLHKTISFKPKQDAVKQEHDRNEDMIRSALRAISSLDRINGVDYSHKFKGLMGDMKRSVPLWEKFQTIRNE

SEQ ID NO: 3354 - protein, 73 aa, Arabidopsis thaliana
LWHRLMGKGILGVQTTASEYLRAYVHCSKRRAGITILLINLSKHTTFTVAVSNGVKVVLQAESMKRKSFLETI

SEQ ID NO: 3355 - protein, 113 aa, Arabidopsis thaliana
LMGKGILGVQTTASEYLRAYVHCSKRRAGITILLINLSKHTTFTVAVSNGVKVVLQAESMKRKSFLETIKSKVSWVGNKASDGYLNREEYHLSPKDGDLRSKIMLLNGKPLVP

SEQ ID NO: 3356 - protein, 525 aa, Arabidopsis thaliana
MKLSALHQSYLNRRSNSFRSPTSLDSSVDGSGKSLIAVFWLILHCLCCLISLVLGFRFSRLVFFFLFSTSSTNLYSLPFRPDLPVKHLDVHTIGRTLDPGANGTTVVATATKSSRVVVGRHGIRIRPWPHPNPVEVMKAHQIIGRVQKEQKMIFGMKSSKMVIAVTPTYVRTFQALHLTGVMHSLMLVPYDLVWIVVEAGGATNETGLIIAKSGLRTIHVGIDQRMPNTWEDRSKLEVFMRLQALRVVREEKLDGIVMFADDSNMHSMELFDEIQNVKWFGTVSVGILAHSGNAEEMVLSMEKRKEMEKEEEEESSSLPVQGPACNSTDQLIGWHIFNTLPYAGKSAVYIDDVAAVLPQKLEWSGFVLNSRLLWEEAENKPEWVKDFGSLNENEGVESPLSLLKDPSMVEPLGSCGRQVLLWWLRVEARADSKFPPGWIIDPPLEITVAAKRTPWPDVPPEPPTKKKDQMPLSQGNTVVVIPKQQQHPTKIRKPKRKSKKSKHEPRPTDTTTQVYSSSSKHQERN

SEQ ID NO: 3357 - protein, 567 aa, Arabidopsis thaliana
MSSSKRKRGAETAAEDCDDGTDKSNTGNSFFDIYGPEAKAELDFKSPETTLNLQDVQGLVTWVLAEGFMPSWVFIKNKPLIPKVVLLYLPGLDAALYLSHSKTLSSLKSCCGNPMALLALSCVVDEMRTIDTILTCKGRKKKTVTSSVEPPPLVSSPEACNLMGKSFVELTKDIPFPVSYYTLSQKEMEQNGYTFEKLELTPTLPAPSGSCPPEIVALDCEMCITKEGLELTRVTLVDIQGQVLLDKLVMPTNPITDYNTRYSGITAVMMEGVTTTLKDIQEEFLKLVFKETILVGHSLENDLLSLKISHNLVIDTAVLYKHPHGRSYKTKLRILAKKFLAREIQESESGHDSAEDAKAAMDLALLKIKHGPDFGSPPEVIRKKLLAVLNESGKTTSIIDNINIVKRYASESSNAIPVSSDDEALSKAVKEVKNKRSQFVWTQFSELNAHFQSRADDPQKLNSRLAEMISLLTCNKKSGLKKSNVSPETKEILKKMNERVQSLYAALPTNAMFIVCTGHGDTSIVHRVRKMLKDEDEIGFDREKLVKVLEELQAQAEVALCFVGIKQ

SEQ ID NO: 3358 - protein, 190 aa, Arabidopsis thaliana
MEHESKNKVDGMEMEKGKKESGSRKGLELTMRVLALVLTMVAATVLGVAKQTKVVPIKLIPTLPPLNVSTTAKASYLSAFVYNISANAIACGYTAISIVIVMISKGKRSKSLLMAVLIGDLMMVALLFSSTGAAGAIGLMGRHGNKHVMWKKVCGVFGKFCNQAAVSVAITLIASVVFMLLVVLDALKLP

SEQ ID NO: 3359 - protein, 322 aa, Arabidopsis thaliana
MAIGDRKKIIIDTDPGIDDAMAIFVALNSPEVDVIGLTTIFGNVYTTLATRNALHLLEVAGRTDIPVAEGTHKTFLNDTKLRIADFVHGKDGLGNQNFPPPKGKPIEKSGPEFLVEQAKLCPGEITVVALGPLTNLALAVQLDPEFSKNVGQIVLLGGAFAVNGNVNPASEANIFGDPEAADIVFTCGADIIAVGINVTHQVIMTADDKDKLASSKGKLAQYLCKILDVYYDYHLTAYEIKGVYLHDPATILAAFLPSLFTYTEGVARVQTSGITRGLTLLYNNLKRFEEANEWSDKPTVKVAVTVDAPAVVKLIMDRLMES

SEQ ID NO: 3360 - protein, 302 aa, Arabidopsis thaliana
MAIFVALNSPEVDVIGLTTIFGNVYTTLATRNALHLLEVAGRTDIPVAEGTHKTFLNDTKLRIADFVHGKDGLGNQNFPPPKGKPIEKSGPEFLVEQAKLCPGEITVVALGPLTNLALAVQLDPEFSKNVGQIVLLGGAFAVNGNVNPASEANIFGDPEAADIVFTCGADIIAVGINVTHQVIMTADDKDKLASSKGKLAQYLCKILDVYYDYHLTAYEIKGVYLHDPATILAAFLPSLFTYTEGVARVQTSGITRGLTLLYNNLKRFEEANEWSDKPTVKVAVTVDAPAVVKLIMDRLMES

SEQ ID NO: 3361 - protein, 59 aa, Arabidopsis thaliana
VKKHSSYLMTVEMSIVGSLCLLVSTLKSPDGEAIKKYGFFHGWTALTLVPVISNALGGI

SEQ ID NO: 3362 - protein, 44 aa, Arabidopsis thaliana
EMSIVGSLCLLVSTLKSPDGEAIKKYGFFHGWTALTLVPVISNA

SEQ ID NO: 3363 - protein, 84 aa, Arabidopsis thaliana
INADQKLFYGIIPVLAASVLSGLASSLCQWASQVKKHSSYLMTVEMSIVGSLCLLVSTLKSPDGEAIKKYGFFHGWTALTLVIN

SEQ ID NO: 3364 - protein, 50 aa, Arabidopsis thaliana
VKKHSSYLMTVEMSIVGSLCLLVSTLKSPDGEAIKKYGFFHGWTALTLVI

SEQ ID NO: 3365 - protein, 313 aa, Arabidopsis thaliana
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 3366 - protein, 389 aa, Arabidopsis thaliana
MVIAAAVIVPLGLLFFISGLAVNLFQAVCYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLKSGLQRLSDFPRPFWLALFVEGTRFTEAKLKAAQEYAASSELPIPRNVLIPRTKGFVSAVSNMRSFVPAIYDMTVTIPKTSPPPTMLRLFKGQPSVVHVHIKCHSMKDLPESDDAIAQWCRDQFVAKDALLDKHIAADTFPGQQEQNIGRPIKSLAVVLSWACVLTLGAIKFLHWAQLFSSWKGITISALGLGIITLCMQILIRSSQSERSTPAKVVPAKPKDNHHPESSSQTETEKEK

SEQ ID NO: 3367 - protein, 496 aa, Triticum aestivum
MAGTGVFADVLDGEVYKYYADGEWRASASGKTVAIVNPTTRQTQYRVQACTQEEVNKVMDAAKVAQKSWARTPLWKRAELLHKAAAILKEHKTPIAESLVKEIAKPAKDAVSEVVRSGDLVSYTAEEGVRILGEGKLLVSDSFPGNERNKYCLSSKVPLGVVLAIPPFNYPVNLAVSKIGPALIAGNSLVLKPPTQGAVAALHMVHCFHLAGFPKGLISCVTGKGSEIGDFLTMHPGVNCISFTGGDTGIAISKKAGMVPLQMELGGKDACIVLEDADLDLVAANIVKGGFSYSGQRCTAVKVVLIMEAVADTVVEKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCVFTRDINKAIMISDAMESGTVQINSAPARGPDHFPFQGLKDSGIGSQGITNSINMMTKVKSTVINLPSPSYTMG

SEQ ID NO: 3368 - protein, 603 aa, Arabidopsis thaliana
MAISSASLISSFSHAETFTKHSKIDTVNTQNPILLISKCNSLRELMQIQAYAIKSHIEDVSFVAKLINFCTESPTESSMSYARHLFEAMSEPDIVIFNSMARGYSRFTNPLEVFSLFVEILEDGILPDNYTFPSLLKACAVAKALEEGRQLHCLSMKLGLDDNVYVCPTLINMYTECEDVDSARCVFDRIVEPCVVCYNAMITGYARRNRPNEALSLFREMQGKYLKPNEITLLSVLSSCALLGSLDLGKWIHKYAKKHSFCKYVKVNTALIDMFAKCGSLDDAVSIFEKMRYKDTQAWSAMIVAYANHGKAEKSMLMFERMRSENVQPDEITFLGLLNACSHTGRVEEGRKYFSQMVSKFGIVPSIKHYGSMVDLLSRAGNLEDAYEFIDKLPISPTPMLWRILLAACSSHNNLDLAEKVSERIFELDDSHGGDYVILSNLYARNKKWEYVDSLRKVMKDRKAVKVPGCSSIEVNNVVHEFFSGDGVKSATTKLHRALDEMVKELKLSGYVPDTSMVVHANMNDQEKEITLRYHSEKLAITFGLLNTPPGTTIRVVKNLRVCRDCHNAAKLISLIFGRKVVLRDVQRFHHFEDGKCSCGDFW

SEQ ID NO: 3369 - protein, 350 aa, Coffea canephora
MAEEEACLFAMSLASASVLPMVLKSAIELDLLELIAKAGPGAYVSPSELAAQLPTHNPEAPIMLDRILRLLATYSVLDCKLNNLADGGVERLYGLAPVCKFLTKNADGVSMAPLLLMNQDKVLMESWYHLKDAVLDGGIPFNKAYGMTAFEYHGTDPRFNKVFNQGMSNHSTITMKKILEVYRGFEGLKTVVDVGGGTGATLNMIISKYPTIKGINFELPHVVEDAPSHSGVEHVGGDMFVSVPKGDAIFMKWICHDWSDDHCRKLLKNCYQALPDNGKVILAECVLPEAPDTSLATQNVVHVDVVMLAHNPGGKERTEKEFEALAKGAGFKEFRKVCSAVNTWIMELCK

SEQ ID NO: 3370 - protein, 92 aa, Arabidopsis thaliana
EALENTYKYGRKAGLTKGLGLGSMHCVLFLSWALLVWFTSVVVHKDIADGGKSFTTMLNVVIAGLSLGQAAPDISAFVRAKAAAYPIFKMIE

SEQ ID NO: 3371 - protein, 80 aa, Arabidopsis thaliana
KAGLTKGLGLGSMHCVLFLSWALLVWFTSVVVHKDIADGGKSFTTMLNVVIAGLSLGQAAPDISAFVRAKAAAYPIFKMI

SEQ ID NO: 3372 - protein, 34 aa, Arabidopsis thaliana
LKIIHTSKKFIGQIYIPVLNWSLLVVCLIVVCST

SEQ ID NO: 3373 - protein, 83 aa, Arabidopsis thaliana
WNYGSKLKYETEVQKKLPMDLLRELGSNLGTIRAPGIGLLYNELAKGVPAIFGHFLTTLPAIHSMVIFVCIKYVPVPSVPQTE

SEQ ID NO: 3374 - protein, 266 aa, Macaca fascicularis
MHVNGKVALVTGAAQGIGRAFAEALLLKGAKVALVDWNLEAGVQCKAALDEKFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDATPFQAKSQ

SEQ ID NO: 3375 - protein, 400 aa, Mizuhopecten yessoensis
MTLKVCVCGGGNGAHTLSGLAASRDGVEVRVLTLFADEAERWTKALGADELTVIVNEKDGTQTEVKSRPKVITKDPQVAITGADVVILTVPAFAHEGYFQAMAPYVQDSALIVGLPSQAGFEFQCRDILGDKAAAVSMMSFETLPWACRIKEFGRKVEVLGTKSVLAASLIKGTAETVDPLSTLQKLHGAEPVFRLAKHFLEMLIMSYSFVHPAILYGRWGSWDGNPVSEAPLFYQGIDQATADMLTACSDECKAVGNAIMAACPGNDLSDVKDIYQWYLEYYHEDIQDDHDLYHAITTNKSYKGLVHPVKTVDGGVAPDFGNRYLTEDIPMGMIVFKGVAIAAGVPIPNNDKLITWAQEKIGKVYLVDGALTGKDVATTRCPQRYGFNTLNAILTGKKE

SEQ ID NO: 3376 - protein, 424 aa, Mus musculus
MAALVALHGVVRRPLLRGLLQEVRCLERSYASKPTLNEVVIVSAIRTPIGSFLGSLASQPATKLGTAAIQGAIEKAGIPKEEVKEVYMGNVIQGGEGQAPTRQATLGAGLPISTPCTTVNKVCASGMKAIMMASQSLMCGHQDVMVAGGMESMSNVPYVMSRGATPYGGVKLEDLIVKDGLTDVYNKIHMGNCAENTAKKMNISRQEQDTYALSSYTRSKEAWDAGKFASEITPITISVKGKPDVVVKEDEEYKRVDFSKVPKLKTVFQKENGTITAANASTLNDGAAALVLMTAEAAQRLNVKPLARIAAFADAAVDPIDFPLAPAYAVPKVLKYAGLKKEDIAMWEVNEAFSVVVLANIKMLEIDPQKVNIHGGAVSLGHPIGMSGARIVVHMAHALKPGEFGLASICNGGGGASALLIEKL

SEQ ID NO: 3377 - protein, 211 aa, Mus musculus
MQTPHKEHLYKLLVIGDLGVGKTSIIKRYVHQNFSSHYRATIGVDFALKVLHWDPETVVRLQLWDIAGQERFGNMTRVYYREAMGAFIVFDVTRPATFEAVAKWKNDLDSKLTLPNGKPVSVVLLANKCDQGKDVLMNNGLKMDQFCKEHGFVGWFETSAKENINIDEASRCLVKHILANECDLLESIEPDIVKPHLTSPKVVSCSGCAKS

SEQ ID NO: 3378 - protein, 656 aa, Mus musculus
MTGAKRKKRSVLWGKMHTPHREDIKQWCKRRLPILEWAPQYNLKENLLPDTVSGIMLAVQQVAQGLSFAMLSSVHPVFGLYGSLFPAIIYAIFGMGRHVATGTFALTSLISANAVERLVPQSSRNLTTQSNSSVLGLSEFELQRIGVAAAVSFLGGVIQLVMFVLQLGSATFLLTEPVISAMTTGAATHVVTSQVKYLLGIKMPYISGPLGFFYIYAYVFENIKSVQLEALLFSLLSIIVLVLVKELNEQFKRKIKVVLPVDLVLIIAASFACYCTNMENTYGLEVVGHIPNGIPPPRAPPMNILSAVLTEAFGVALVGYVASLALAQGSAKKFKYSVDDNQEFLAHGLSNVIPSFLFCIPSAAAMGRTAGLYSTGAKTQVACLISCIFVLIVIYAIGPLLYWLPMCVLASIIVVGLKGMLIQFRDLKKYWNVDKIDWGIWISTYIFTICFAANVGLLFGVICTIAIVLGRFPRAKTLSITDMKEMELKVKTEMHDETSQQIKIISINNPLVFLNAKKFSADLMKIILKESDSNQPLDDVSKCEQNTLLSSLSNGNCNEEASQPCSSEKCSLVLNCSGLTFFDYTGVSTLVELYLDCKSRSVDVFLANCTASLIKAMTYYGDLDTEKPIFFDSVPAAISIIQSNKNLSKASDHSEV

SEQ ID NO: 3379 - protein, 84 aa, Mus musculus
SKLELHQQEQQTLQTDAVNAKVLLGKCINVVLAFMTVILVCVSTLAKFVSPMMKSRSHILGTFFAVTLLAIFCKNWDHILCAIE

SEQ ID NO: 3380 - protein, 58 aa, Mus musculus
KVLLGKCINVVLAFMTVILVCVSTLAKFVSPMMKSRSHILGTFFAVTLLAIFCKNWDH

SEQ ID NO: 3381 - protein, 84 aa, Mus musculus; identical to SEQ ID NO: 3379

SEQ ID NO: 3382 - protein, 58 aa, Mus musculus; identical to SEQ ID NO: 3380

SEQ ID NO: 3383 - protein, 80 aa, Rattus norvegicus
KTVLLLMGILTAYVLCWAPFYGFTIVRDFFPTLVVKEKHYLTAFYVVECIAMSNSMINTICFVTVKNNTMKYFKKMLLLH

SEQ ID NO: 3384 - protein, 110 aa, Rattus norvegicus
KTVLLLMGILTAYVLCWAPFYGFTIVRDFFPTLVVKEKHYLTAFYVVECIAMSNSMINTICFVTVKNNTMKYFKKMLLLHWRPSHYGSKSSADLDLKTSGVPATEEVDCI

SEQ ID NO: 3385 - protein, 944 aa, Rattus norvegicus
MGRRFKFLQKLAFLGQNHRYKALERDEVDTLIDEQYELKAIEREKAVAALPPREACKCSKEELARTFHVDLDSGLSEFAVAQRRLVHGWNEFVTDNTEPVWKKYLDQFRNPLILLLLGSSVVSVLTKEYEDAISIALAVLIVVTVGFIQEYRSEKSLEELTKLVPPECNCLRDGKLRHMLARDLVPGDVVSLSMGDRIPADIRLTEVTDLLVDESSFTGEVEPCSKTDSPLAGGGDLSTLSNVVFMGTLVQCGKGQGVVIGTGEQSQFGEVFKMMRAEETPKTPLQKSMDKLGKQLTVFSFGIIGLLMLVGWVQGKPLLSMFTIGVSLAVAAIPEGLPIVVMVTLVLGVLRMAKKRVIVKKLPIVETLGCCNVICSDKTGTLTANEMTATQLVTSDGFHAEVSGIGYSGEGTVCLLPSKEVIKEFSNVSVGKLVEAGCVANNAVVRKNAVMGQPTEGALVVLAMKMNLGSIKDSYIRKKEIPFSSEQKWMAVRCSLKNEDEEDVYFMKGAFEEVIHHCSTYNNGGIPLPLTPQQKSYCQQEEKKMGSLGLRVLALASGPELGRLTFLGLVGIIDPPRAGVKEAVQALSESDVSVKMVTGDALETALAIGRTIGLCDEKLKAMSGEEVEGMEQDALAARVRQVSVFFRTSPKHKVKIIKALQESGAIVAMTGDGVNDSVALKSADIGIAMGQTGTDVSKEAADMILVDDDFSAIMSAVEEGKGIFYNIKNFVRFQLSTSIAALSLITLSTVCNLPNPLNAMQILWVNIIMDGPPAQSLGVEPVDRDALKRPPRSVKDTILNRALILKILMSAAVILGGTLFIFWREIPENRTSTPRTTTMAFTCFVFFDLFNALSCRSQTKLIFEIGFFRNRMFLYSILGSLLGQLAVIYAPPLQKVFQTENLSALDLLLLTGLASSVFILSELLKLCEKFCSRAKADQMLPEAV

SEQ ID NO: 3386 - protein, 284 aa, Mus musculus
MLSHPLPQVKVETYQCCLEIVKECLGVQNVTKPVSSLCSGIHFLLHPKVLYEISAFGIQESKNEVNAAAKAILLYLLQGRLMMTALTWNKFIESLAPVIPVLQGYADTEDPLGNCILLLSKVSSEAGEGALPCTARLKSVLRLLLVKKPSVRSLALKLLAFHLTSEEGADKKRPFIDAGVLSRVTNLFIVKKPIDLKLDDRRELVIKLETVKKVCDIFTSDDVDLVLRKSAAEQLAVIMQGNEDFVLFCSVLFCSVLFCSVLSCFVLFCFLTVIVAHLGFEIAV

SEQ ID NO: 3387 - protein, 741 aa, Rattus norvegicus
MAETVSPLKHFVLAKKAITAIFGQLLEFVTEGSHFVEATYRNPELDRIATEDDLVEIQGYRNKLAVIGEVLSRRHMKVAFFGRTSSGKSSVINAMLWDKVLPSGIGHTTNCFLSVEGTDGDKAYLMTEGSDEKKSVKTVNQLAHALHMDKDLKAGCLVHVFWPKAKCALLRDDLVLVDSPGTDVTTELDIWIDKFCLDADVFVLVANSESTLMNTEKHFFHKVNERLSKPNIFILNNRWDASASEPEYMEDVRRQHMERCLHFLVEELKVVSPLEARNRIFFVSAKEVLNSRMNKAQGMPEGGGALAEGFQARLQEFQNFEQTFEECISQSAVKTKFEQHTIRAKQILDTVKNILDSVNVAAAEKRVYSMEEREDQIDRLDFIRNQMNLLTMDVKKKIKEVTEEVANKVSCAMTDEICRLSVLVDEFCSEFHPTPSVLKVYKSELNKHIEDGMGRNLADRCTSEVNASILQSQQEIIENLKPLLPAGIQNKLHTLIPCKKFDLSYDLNCHKLCSDFQEDIVFRFSLGWSSLVHRFLGSTNAQRVLLGLSEPIFQVPRSLASTPTAPSNPAAPDNAAQEELMITLITGLASLTSRTSMGIIVVGGVIWKTVGWKLISVTLSMYGALYLYERLTWTTRAKERAFKQQFVNYATEKLQMIVKFTSANCSHQVQQEMATTFARLCQQVDVTQKHLEEEIARLSKEIDQLEKIQNNSKLLRNKAVQLERELENFSKQFLHPSSGES

SEQ ID NO: 3388 - protein, 803 aa, Mus musculus
MIPVTEFRQFSEQQPAFRVLKPWWDVFTDYLSVAMLMIGVFGCTLQVMQDKIICLPKRVQPAQNHSSVPNVSQAVISTTPLPPPKPSPTNPATVEMKGLKTDLDLQQYSFINQMCYERALHWYAKYFPYLVLIHTLVFMLCSNFWFKFPGSSSKIEHFISILGKCFDSPWTTRALSEVSGEDSEEKDNRKNNMNRSGTIQSGPEGNLVRSQSLKSIPEKFVVDKSAAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWLFYRSLREYSFEYVRQETGIDDIPDVKNDFAFMLHMIDQYDPLYSKRFAVFLSEVSENKLKQLNLNNEWTPDKLRQKLQTNAHNRLELPLIMLSGLPDTVFEITELQSLKLEIIKNVMIPATIAQLDNLQELCLHQCSVKIHSAALSFLKENLKVLSVKFDDMRELPPWMYGLRNLEELYLVGSLSHDISKNVTLESLRDLKSLKILSIKSNVSKIPQAVVDVSSHLQKMCVHNDGTKLVMLNNLKKMTNLTELELVHCDLERIPHAVFSLLSLQELDLKENNLKSIEEIVSFQHLRKLTVLKLWYNSIAYIPEHIKKLTSLERLFFSHNKVEVLPSHLFLCNKIRYLDLSYNDIRFIPPEIGVLQSLQYFSITCNKVESLPDELYFCKKLKTLKIGKNSLSVLSPKIGNLLFLSYLDIKGNHFEVLPPELGDCRALKRAGLVVEDALFETLPSDVREQMKAD

SEQ ID NO: 3389 - protein, 121 aa, Mus musculus
VVDKSAAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWL

SEQ ID NO: 3390 - protein, 103 aa, Mus musculus; identical to SEQ ID NO: 70

SEQ ID NO: 3391 - protein, 205 aa, Mus musculus
MAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPVCVEQGQKLAKEIGACCYVECSALTQKGLKTVFDEAIIAILTPKKHTVKKRIGSRCINCCLIT

SEQ ID NO: 3392 - protein, 413 aa, Mus musculus
MSSDMRVHSWSCSYYLDLEKQWVSGKLTLTPHSLKFIVEKTEEVLVGLPLSSIIEIRKESSLFIFGAITVLEKGQTKHWFSSLQPSRNVVFNVIEHFWRELLLSQPGTAANIPSHVTRGQELIGLMANSQKRMEDTAKDLQQQSEQLDSVLKGLEKMESDLDVADRLLTELETPSWWPFGSKFWKMPAEENLKEGVSSTCEPFGKEGVVITVPAIISERAESHSKLGKLTVLVSALEIYDSCSLLLHRFEKEDVDDIKVHSPYEVSIRQRFIGKPDVAYQLISAKMPEVIPILEVQFSSKIELLEDALVLRNKVFASSAERHAASRPKGCTPHRELPTGGQEGEQLQLQKNLPLFSEGEAQELTQILSKMKGLALDTEAELERQDAALDGITVAVDRATLNVDKQNRRMRKLM

SEQ ID NO: 3393 - protein, 886 aa, Mus musculus
MHDAFEPVPILEKLPLQIDCLAAWEEWLLVGTKQGHLLLYRIRKDVVPADVASPESGSCNRFEVTLEKSNKNFSKKIQQIHVVSQFKILVSLLENNIYVHDLLTFQQITTVSKAKGASLFTCDLQHTETGEEVLRMCVAVRKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIVAVLPRYVEIRTLEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPTLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLNFLIENFKALAIPYLEHIIHVWEETGSQFHNCLIQLYCEKVQSLMKDYLLSLPTGKSPVPAGEEGGELGEYRQKLLMFLEISSHYDPGRLICDFPFDGLLEERALLLGRMGKHEQALFIYVHVLKDTKMAKEYCHKHYDQNKEGNKDVYLSLLRMYLSPPSIHCLGPIKLELLEPQANLQAALQVLELHYSKLDTTKAINLLPANTQINDIRIFLEKVLEENAQKKRFNQVLKNLLHAEFLRVQEERILHQQVKCIITEEKVCMVCKKKIGNSAFARYPNGVVVHYFCSKEVNSADT

SEQ ID NO: 3394 - protein, 875 aa, Mus musculus
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVRKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIVAVLPRYVEIRTLEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPTLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLNFLIENFKALAIPYLEHIIHVWEETGSQFHNCLIQLYCEKVQSLMKDYLLSLPTGKSPVPAGEEGGELGEYRQKLLMFLEISSHYDPGRLICDFPFDGLLEERALLLGRMGKHEQALFIYVHVLKDTKMAKEYCHKHYDQNKEGNKDVYLSLLRMYLSPPSIHCLGPIKLELLEPQANLQAALQVLELHYSKLDTTKAINLLPANTQINDIRIFLEKVLEENAQKKRFNQVLKNLLHAEFLRVQEERILHQQVKCIITEEKVCMVCKKKIGNSAFARYPNGVVVHYFCSKEVNSADT

SEQ ID NO: 3395 - protein, 131 aa, Mus musculus
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVRK

SEQ ID NO: 3396 - protein, 197 aa, Mus musculus
TLEKSNKNFSKKIQQIHVVSQFKILVSLLENNIYVHDLLTFQQITTVSKAKGASLFTCDLQHTETGEEVLRMCVAVRKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIVAVL

SEQ ID NO: 3397 - protein, 87 aa, Arabidopsis thaliana
DYSSEHNLVDFRVKKLAFTCIEAIHQNRNRLRDQLLVTPEEASISTAILMEAVSLLLDPKLPWVCKIVSYLQKRKVFKLVREMVTTA

SEQ ID NO: 3398 - protein, 106 aa, Arabidopsis thaliana
LDPKLPWVCKIVSYLQKRKVFKLVREMVTTAKESPRGKTMTGNILSLERVLILIVPHIGREPCCCTVVDPRWSFSSMILTIPLIWKLFPNLKVVFANPSLSQHYIH

SEQ ID NO: 3399 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 3400 - protein, 58 aa, Arabidopsis thaliana
DNQLLSIGGHTKDPSESMPVMVFDLHCCSWSILKTYGKPPISRGGQSVTLVGKSLVIF

SEQ ID NO: 3401 - protein, 34 aa, Arabidopsis thaliana
LHCCSWSILKTYGKPPISRGGQSVTLVGKSLVIF

SEQ ID NO: 3402 - protein, 118 aa, Arabidopsis thaliana
ILKESHQNCIMVVDDDDFLAGILTHGDIRRYLSNNASTILDENTCPVSSVCTKKISYRGQERGLLTCYPDATVGVAKELMEARGVKQLPVVKRGEVIHKGKRRKLLGLLHYDSIWTFL

SEQ ID NO: 3403 - protein, 490 aa, Arabidopsis thaliana
MENGSGKVLKPMDSEQLREYGHLMVDFIADYYKTIEDFPVLSQVQPGYLHKLLPDSAPDHPETLDQVLDDVRAKILPGVTHWQSPSFFAYYPSNSSVAGFLGEMLSAGLGIVGFSWVTSPAATELEMIVLDWVAKLLNLPEQFMSKGNGGGVIQGSASEAVLVVLIAARDKVLRSVGKNALEKLVVYSSDQTHSALQKACQIAGIHPENCRVLTTDSSTNYALRPESLQEAVSRDLEAGLIPFFLCANVGTTSSTAVDPLAALGKIANSNGIWFHVDAAYAGSACICPEYRQYIDGVETADSFNMNAHKWFLTNFDCSLLWVKDQDSLTLALSTNPEFLKNKASQANLVVDYKDWQIPLGRRFRSLKLWMVLRLYGSETLKSYIRNHIKLAKEFEQLVSQDPNFEIVTPRIFALVCFRLVPVKDEEKKCNNRNRELLDAVNSSGKLFMSHTALSGKIVLRCAIGAPLTEEKHVKEAWKIIQEEASYLLHK

SEQ ID NO: 3404 - protein, 347 aa, Arabidopsis thaliana
MATTTQHMNQIFLVLLLISFAISPAISTVPKECETDSTDSCIDKTKALPLKIVAIVAILVTSMIGVAAPLFSRYVTFLHPDGKIFMIIKCFASGIILGTGFMHVLPDSFEMLSSPCLEDNPWHKFPFTGFVAMLSGLVTLAIDSIATSLYTKKAVADDSEERTTPMIIQIDHLPLTTKERSSTCSKQLLRYRVIATVLELGIIVHSVVIGLSLGATNDTCTIKGLIAALCFHQMFEGMGLGGCILQAEYTNVKKFVMAFFFAVTTPSGIALGIALSSVYKDNSPTALITVGLLNACSAGLLIYMALVDLLAAEFMGSMLQRSVKLQLNCFGAALLGCGGMSVLAKWA

SEQ ID NO: 3405 - protein, 615 aa, Solanum lycopersicum
MCTLSFMYPNSLLDGTCKTVALGDSKPRYNKQRSSCFDPLIIGNCTDQQQLCGLSWGVDKAKGRRGGTVSNLKAVVDVDKRVESYGSSDVEGNESGSYDAIVIGSGIGGLVAATQLAVKGAKVLVLEKYVIPGGSSGFYERDGYKFDVGSSVMFGFSDKGNLNLITQALAAVGRKLEVIPDPTTVHFHLPNDLSVRIHREYDDFIEELVSKFPHEKEGIIKFYSECWKIFNSLNSLELKSLEEPIYLFGQFFKKPLECLTLAYYLPQNAGSIARKYIRDPGLLSFIDAECFIVSTVNALQTPMINASMVLCDRHFGGINYPVGGVGEIAKSLAKGLDDHGSQILYRANVTSIILDNGKAVGVKLSDGRKFYAKTIVSNATRWDTFGKLLKAENLPKEEENFQKAYVKAPSFLSIHMGVKADVLPPDTDCHHFVLEDDWTNLEKPYGSIFLSIPTVLDSSLAPEGHHILHIFTTSSIEDWEGLSPKDYEAKKEVVAERIISRLEKTLFPGLKSSILFKEVGTPKTHRRYLARDSGTYGPMPRGTPKGLLGMPFNTTAIDGLYCVGDSCFPGQGVIAVAFSGVMCAHRVAADLGFEKKSDVLDSALLRLLGWLRTLA

SEQ ID NO: 3406 - protein, 184 aa, Arabidopsis thaliana
AVKQWCKQILKGLLYLHSRSPPIIHRDLKCDNIFINGNQGEVKIGDLGLAAILRKSHAVRCVGTSKPSHHWNFIALIMFFTTLDLPLLCLCVVKGTPEFMAPEVYDEEYNELVDVYAFGMCVLEMVTFDYPYSECTHPAQIYKKVTSGKKPEAFYLVKDPEVREFVEKCLANVTCRLTALELLQ

SEQ ID NO: 3407 - protein, 53 aa, Arabidopsis thaliana
VKIGDLGLAAILRKSHAVRCVGTSKPSHHWNFIALIMFFTTLDLPLLCLCVVK

SEQ ID NO: 3408 - protein, 473 aa, Bos taurus
MAYPWTFTFLCGLLAANLVGATLSPPVVLSLSTEVIKQMLAQKLKNHDVTNTLQQLPLLTAMEEESSRGIFGNLVKSILKHILWMKVTSASIGQLQVQPLANGRQLMVKAPLDVVAGFNVPLFKTVVELHVEVEAQAIIHVETREKDHARLVLSECSNTGGSLRVSLLHKLSFLLKCLADKVISLLTPAPPKLVKSELCPVLKAGFEDMRGELLNLTKVPMSLNSEHLKLDFISPVIDHSVVHLILGARLFNSEGKVTKLFNVAGDSLNLPTLNQTPFRLTVRKDVVVAIIAALIHSGKLTVLLDYVLPEVARQLRSSIKVIDETAAAQLGPTQIVKIMSQTTPMLILDQGNAKVAQLIVLEIFATDKDSRPLFTLGIEASSDIQFYVEDGLLVFSFNEIRADRIHLMNSDIGVFNPKLLNNITTKILTSILLPNENGKLRSGIPVSMVKNLGFKSISLSLTKEALVVTQASS

SEQ ID NO: 3409 - protein, 294 aa, Encephalitozoon cuniculi
MFSGFVGPDDGEPTSDASETVQISSLALLKMLKHGRAGIPLEVMGLMLGEFVDEYTVKVVDVFAMPQSGTNVTVESVDPIFQMEMMSILKATGRHETVVGWYHSHPGFGCWLSTVDISTQQSFEKLCKRAVAVVVDPIQSVKGKVVIDAFRLIDNQLGVLGGEPRQVTSNIGYLKTPTLISIIHGLNKHYYSFNITCRKNDFEQKMLLNLHRKTWADNLKLGDVRSKREEALKLIESYGKAFEEEKNLAGKNPDMAKVGRIDYRRRLLEKCEESIMENTIYSLLYSIHRYIFTQ

SEQ ID NO: 3410 - protein, 115 aa, Dictyostelium discoideum
LNSVLRKFTPTTSVPSTNEVTDFIESCHHFPSKLLICKLVQRYLVPREFQRHLSDIDWVKMVERPIQLRVGKLLKKVIDQKKVNFDYGTMLILRSFIRGYIQSTSDMAKGLIVGL

SEQ ID NO: 3411 - protein, 83 aa, Dictyostelium discoideum
TTSVPSTNEVTDFIESCHHFPSKLLICKLVQRYLVPREFQRHLSDIDWVKMVERPIQLRVGKLLKKVIDQKKVNFDYGTMLIL

SEQ ID NO: 3412 - protein, 296 aa, Drosophila melanogaster
MLSSSCPGWVCYAEKTHGNFLLPYVSTTRSPQQIMGVLVKQILADKMNVPASRIYHVTVMPCYDKKLEASREDFFSKANNSRDVDCVITSVEVEQLLSEAQQPLSQYDLLDLDWPWSNVRPEFMVWAHEKTLSGGYAEHIFKYAAKHIFNEDLKTELEFKQLKNRDFREIILKQNGKTVLKFAIANGFRNIQNLVQKLKREKVSNYHFVEVMACPSGCINGGAQIRPTTGQHVRELTRKLEELYQNLPRSEPENSLTKHIYNDFLDGFQSDKSYDVLHTRYHDVVSELSISLNINW

SEQ ID NO: 3413 - protein, 92 aa, Dictyostelium discoideum
CGLSKSYTKLFRPKKTVHAVKYLSLSVEKGTILGFLGSNGCGKSTTIGMLTGLLEPTAGDALVYGHSVISNIAAVRRITSVVPQHDILWAEM

SEQ ID NO: 3414 - protein, 80 aa, Dictyostelium discoideum
AVVEFVTLSIPGCKFMKQSALQLNFGFPVTIDHQIIANFFKQLEEITNDPNNQLMRDWSVSHSTLDDVFLKVSHLAKLKT

SEQ ID NO: 3415 - protein, 388 aa, Pyrococcus furiosus
MWFGEFGGQYVPETLIEPLKELEKAYKRFKDDEEFNRQLNYYLKTWAGRPTPLYYAKRLTEKIGGAKIYLKREDLVHGGAHKTNNAIGQALLAKFMGKTRLIAETGAGQHGVATAMAGALLGMKVDIYMGAEDVERQKMNVFRMKLLGANVIPVNSGSRTLKDAINEALRDWVATFEYTHYLIGSVVGPHPYPTIVRDFQSVIGREAKAQILEAEGQLPDVIVACVGGGSNAMGIFYPFVNDKKVKLVGVEAGGKGLESGKHSASLNAGQVGVFHGMLSYFLQDEEGQIKPTHSIAPGLDYPGVGPEHAYLKKIQRAEYVTVTDEEALKAFHELSRTEGIIPALESAHAVAYAMKLAKEMSRDEIIIVNLSGRGDKDLDIVLKVSGNV

SEQ ID NO: 3416 - protein, 327 aa, Mus musculus
MAAQESLHVKTPLRDSMALSKLAGTSVFLKMDSSQPSGSFKIRGIGHLCKMKAKQGCRHFVCSSAGNAGMATAYAARRLGIPATIVVPNTTPALTIERLKNEGATVEVVGEMLDEAIQVAKALEKNNPGWVYISPFDDPLIWEGHTSLVKELKETLSAKPGAIVLSVGGGGLLCGVVQGLREVGWEDVPIIAMETFGAHSFHAAIKEGKLVTLPKITSVAKALGVNTVGAQTLKLFYEHPIFSEVISDQEAVSALEKFVDDEKILVEPACGAALAAVYSRVVCRLQDEGRLQTPLASLVVIVCGGSNISLAQLQALKVQLGLNGLPE

SEQ ID NO: 3417 - protein, 34 aa, Mus musculus
KLKSVAHLPWRMLTYKALNTFIDDLFAFVIKMPV

SEQ ID NO: 3418 - protein, 32 aa, Mus musculus
KSVAHLPWRMLTYKALNTFIDDLFAFVIKMPV

SEQ ID NO: 3419 - protein, 269 aa, Mus musculus
MHVNGKVALVTGAAQGIGKAFAEALLLHGAKVALVDWNLEAGVKCKAALDEQFEPQKTLFVQCDVADQKQLRDTFRKVVDHFGRLDILVNNAGVNNEKNWEQTLQINLVSVISGTYLGLDYMSKQNGGEGGIIINMSSLAGLMPVAQQPVYCASKHGIIGFTRSAAMAANLMKSGVRLNVICPGFVDTPILESIEKEENMGQYIEYKDQIKAMMKFYGVLHPSTIANGLINLIEDDALNGAIMKITASKGIHFQDYDISPLLVKAPLTS

SEQ ID NO: 3420 - protein, 123 aa, Mus musculus
MESGSRPSLGQVILLGTSSMVTAVLYSIYRQKAQVAQELKGAKKIHLGEDLKGILSEAPGKCVPYAVIEGAVRSVKETLNSQFVENCKGVIQRLSLQEHKMVWNRTTHLWCVSSGFYTSEVVV

SEQ ID NO: 3421 - protein, 122 aa, Mus musculus
MKLKQRVVLLAILLVIFIFTKVFLIDNLDTSAANREDQRAFHRMMTGLRVELVPKLDHTLQSPWEIAAQWVVPREVYPEETPELGAIMHAMATKKIIKADVGYKGTQLKALLILEGGQKVVF

SEQ ID NO: 3422 - protein, 116 aa, Mus musculus
VLLAILLVIFIFTKVFLIDNLDTSAANREDQRAFHRMMTGLRVELVPKLDHTLQSPWEIAAQWVVPREVYPEETPELGAIMHAMATKKIIKADVGYKGTQLKALLILEGGQKVVFK

SEQ ID NO: 3423 - protein, 319 aa, Rattus norvegicus
MLLWVLALLFLCAFLWNYKGQLKIADIADKYIFITGCDSGFGNLAARTFDRKGFRVIAACLTESGSEALKAKTSERLHTVLLDVTNPENVKETAQWVKSHVGEKGLWGLINNAGVLGVLAPTDWLTVDDYREPIEVNLFGLINVTLNMLPLVKKARGRVINVSSIGGRLAFGGGGYTPSKYAVEGFNDSLRRDMKAFGVHVSCIEPGLFKTGLADPIKTTEKKLAIWKHLSPDIKQQYGEGYIEKSLHRLKSSTSSVNLDLSLVVECMDHALTSLFPKTRYTAGKDAKTFWIPLSHMPAALQDFLLLKEKVELANPQAV

SEQ ID NO: 3424 - protein, 309 aa, Mus musculus
MAADEDELNLLVIIVDTNPIWWGKQALKESQFTLSKCMDAVMVLANSHLFMNRSNQLAVIASHIQESRLLYPGKNGGLGDFFGDPGNALPDCNPSGSKDGKYELLTVANEVIAEEIKDLMTKSDIKGQHTETLLAGSLAKALCYIHRVNKAVKDNQEMKSRILVIKAAEDSALQYMNFMNVIFAAQKQNILIDACVLDSDSGLLQQACDITGGLYLKVPQMPSLLQYLLWVFLPDQDQRSQLILPPPIHVDYRAACFCHRSLIEIGYVCSVCLSIFCNFSPICTTCETAFKISLPPVLKAKKKKQKVSL

SEQ ID NO: 3425 - protein, 38 aa, Mus musculus
MAGKKSSGKRSWPLLGLLVTVATIHLVICPYTKVEESF

SEQ ID NO: 3426 - protein, 24 aa, Mus musculus
TYILNKKSWPYKVRAMLVTGHILV

SEQ ID NO: 3427 - protein, 311 aa, Mus musculus
MAHVALIPGLSRGSVGAVCTQAASWGLKASTLRHLTLASIIKSRRKTDHLERTASVLRREVMAAAKVCEITHESPSVKSLRLLVADKDFSFKAGQWVDFFIPGVSVVGGFSICSSPQRLERDRIIELAVKYADHPPAVWVHNKCTLDSEVALRVGGEFFFDPQPTDAPRNLILIAGGVGINPLLSILRHSADLHRDHADKGRSYEIGTVKLFYSAKNTSELLFKKDILDLVHEFPEKISCSFHVTKQTAQISAELKPYVTDGRITEKEIRDHISAETLFYVCGPPPMTDFFSKHLESCHVPKEHICFEKWW

SEQ ID NO: 3428 - protein, 199 aa, Mus musculus
MNPRKKVDLKLIIVGALGVGKTSLLHQYVHKTFFEEYQTTLGASILSKIIILDDTTLKLQIWDTGGQERFRSMVSTFYKGSDGCILAFDVTDPESFEALDIWRDDVLAKIIPMEQSYPMVVLGNKIDLEDRKVSQEVVHGWCKEKDMPYFEVSAKNDINVVQAFEVLASRALLRYQGTAENHLIDSIKLSPGQPKSRCC

SEQ ID NO: 3429 - protein, 393 aa, Mus musculus
MLPAVKTVEAEEEYAEDCPELVPIETKNQEEENLDFITKIPVTIVTGYLGAGKTTLLNYILTEQHNRKIAVILNEFGEGSAVEKSLAVSQGGELYEEWLELRNGCLCCSVKDSGLRAIENLMQKKGKFDYILLETTGLADPGAVASMFWVDAELGSDIYLDGIITVVDSKYGLKHLTEEKPDGLVNEATRQVALADMILINKTDLVSEEELNNLRTTIRSINGLGKVLETQRSRVHLSNILDLHAYDILSGISLQKKLQHVSTAPHLDQSIVTVTFEVPGSAKEECLNVFIQNLLWEKNVKNKDGHCMEVIRLKGLVSIKDKPQQMIVQGIHELYDLEESLVNWKDDAERACQLVFIGRNLDKDVLQQLFLTAVAEAEEQRTAPGRDGVCPSH

SEQ ID NO: 3430 - protein, 287 aa, Mus musculus
MAHLFKEKSNCYFCFRCLESPVYLNCGYICCLKCLDSLEKSPEGDGVLCPTCSVVSLKEDIIHAKQLGALVTKIKNLEPQLNFILTMDQGMKIFQVTMTLDVDTAQNHLIISDDLLSVYYTPQKQARKKCAERFHPSPCVLGSSRFTSGRHYWEVVVGTSKEWDIGICKESINRKKAIHLSEKNGFWTVGVRAKKVYSASTDPLTVLRVNPRLRRVGIFLDMLEKSVSFWDLSDGSHIYTFLEIPDTDPFRPFFSPASSYPDGDQEQVLSICPVTNPGIFGIPVNPQ

SEQ ID NO: 3431 - protein, 190 aa, Mus musculus
LESPVYLNCGYICCLKCLDSLEKSPEGDGVLCPTCSVVSLKEDIIHAKQLGALVTKIKNLEPQLNFILTMDQGMKIFQVTMTLDVDTAQNHLIISDDLLSVYYTPQKQARKKCAERFHPSPCVLGSSRFTSGRHYWEVVVGTSKEWDIGICKESINRKKAIHLSEKNGFWTVGVRAKKVYSASTDPLTVL

SEQ ID NO: 3432 - protein, 129 aa, Mus musculus
ICCLKCLDSLEKSPEGDGVLCPTCSVVSLKEDIIHAKQLGALVTKIKNLEPQLNFILTMDQGMKIFQVTMTLDVDTAQNHLIISDDLLSVYYTPQKQARKKCAERFHPSPCVLGSSRFTSGRHYWEVVV

SEQ ID NO: 3433 - protein, 609 aa, Rattus norvegicus
MWITALLLVVLLLVVVHRVYVGLFTGSSPNPFAEDVKRPPEPLVTDKEARKKVLKQAFSVSRVPEKLDAVVIGSGIGGLASAAVLAKAGKRVLVLEQHTKAGGCCHTFGENGLEFDTGIHYIGRMREGNIGRFILDQITEGQLDWAPMASPFDLMILEGPNGRKEFPMYSGRKEYIQGLKEKFPKEEAVIDKYMELVKVVAHGVSHAILLKFLPLPLTQLLNKFGLLTRFSPFCRASTQSLAEVLKQLGASPELQAVLSYILPTYGVTPSHTTFSLHALLVDHYIQGAYYPRRGSSEIAFHTIPLIQRAGGAVLTRATVQSVLLDSAGRACGVSVKKGQELVNIYCPVVISNAGMFNTYQHLLPESVRYLPDVKKQLTMVKPGLSMLSIFICLKGTKEELKLQSTNYYVYFDTDMDKAMECYVSMPKEKAPEHIPLLFIPFPSSKDPTWEDRFPDRSTMTVLVPTAFEWFEEWQEEPKGKRGVDYETLKNTFREASMSVIMKLFPQLEGKVESVTGGSPLTNQYYLAAHRGATYGADHDLARLHPHAMASLRAQTPIPNLYLTGQDIFTCGLMGALQGALLCSSAILKRNLYSDLQALGSKVRAQKKKK

SEQ ID NO: 3434 - protein, 120 aa, Mus musculus
GHVNRQEKEEKEAIYKERWPAYIKELRTRYSASTVDVLQMMDDDKVDLNLIAALIRYIVLEEEDGAILVFLPGWDNISTLHDLLMSQVMFKSDKFLIIPLHSLMPTVNQTQVFKKTPPGV

SEQ ID NO: 3435 - protein, 57 aa, Mus musculus
LVFLPGWDNISTLHDLLMSQVMFKSDKFLIIPLHSLMPTVNQTQVFKKTPPGVRKIV

SEQ ID NO: 3436 - protein, 101 aa, Rattus norvegicus
IVTVVPQDTKLILQMPRGNLEVVHHRALVLAQIRKWLDKLMFKEAFECMRKLRINLNLIHDHNPKVFLENVETFIKQIDSVNHLNLFFTELKEEDVTKTMY

SEQ ID NO: 3437 - protein, 141 aa, Rattus norvegicus
ALVLAQIRKWLDKLMFKEAFECMRKLRINLNLIHDHNPKVFLENVETFIKQIDSVNHLNLFFTELKEEDVTKTMYPPPVTKSVQVSTNPDGKKVDLICDAMRVAMETINPRKFCLSILTSHVKKTTPELDIVLQKVHELQG

SEQ ID NO: 3438 - protein, 1543 aa, Mus musculus
MDEFCNSTFWNLSLLKSPEADLPLCFEQTVLVWIPLGFLWLLAPWQLYRIYRSRTKRFAITKFYLAKQVFVVCLLILAAIDLSLALTEDTGQATIPPVKYTNPILYLCTWLLVLVIQHCRQCCIQKNSWFLSMFWILSLLCGIFQFQTLIRALLQDSKSNMTYSCLFFVSYGFQIVILILSAFSESSDSTHAPSATASFLSSVTFSWYDSTVLKGYKHPLTIEDVWDIEENLKAKSLTSKFKTIMTKDLQKARQALQRRLKKSQQSPEGTSHGLTKKQSQSQDVLVLEDSKKKKKKSEATKDFPKSWLVKALFKTFYVVILKSFILKLAHDILLFLNPQLLKFLIGFVKDPDSYPWVGYIYAILMFSVTLIQSFFLQCYFQFCFVLGMTVRTTIIASVYKKALTLSNLARRQYTIGETVNLMSVDSQKLMDVTNYIHLLWSSVLQIALSIFFLWRELGPSILAGVGLMVLLVPVNGVLATKIRKIQVQNMKNKDKRLKIMNEILSGIKILKYFAWEPSFKEQVNSIRKKELRNLLRFSQLQTILIFILHLTPTLVSVITFSVYVLVDSQNVLNAEKAFTSITLFNILRFPLAMLPMVISSVIQASVSVDRLEQYLGSDDLDLSAIRHVCHFDKAVQFSEASFTWDRDLEATIQDVNLDIKPGQLVAVVGTVGSGKSSLISAMLGEMENVHGHITIKGSIAYVPQQAWIQNGTIKDNILFGSEYDEKKYQRVIEACALLPDLEMLPGGDMAEIGEKGINLSGGQKHRVSLARATYQDADIYILDDPLSAVDTHVGKHIFNKVVGPNGLLSGKTRILVTHGIHFLPQVDEIVVLGKGTILEKGSYSDLMDKKGVFAKNWKTFMKHSGPEGEATVDNDSEEEDGDCGLIPTVEEIPDDAASLTMRRENSLRRTLSRSSRSGSRRGKSLKSSLKIKSVNALNKKEEVVKGQKLIKKEFVETGKVKFSIYLKYLQAVGWWSLLFIVIFYVLNYVAFIGTNLWLSAWTSDSEKQNGTDNSPSQRDMRIGVFGALGIAQGIFLLSSSLWSIYACRNASKTLHRQLLTNILRAPMSFFDTTPTGRIVNRFAGDISTVDDTLPQTLRSWLLCFFGIVSTLVMICMATPIFIIIIIPLSILYVSVQVFYVATSRQLRRLDSVTKSPIYSHFSETVSGLPVIRAFEHQQRFLANSEKQIDTNQKCVFSWITSNRWLAIRLELVGNLIVFCSALLLVIYKNSLTGDTVGFVLSNALNITQTLNWLVRMTSEVETNIVAVERINEYINVDNEAPWVTDKKPPADWPKKGEIQFNNYQVRYRPELDLVLKGITCNIKSTEKVGVVGRTGAGKSSLTNCLFRILESAGGQIIIDGIDIASIGLHDLRGRLTIIPQDPILFSGNLRMNLDPFNKYSDEEIWRALELAHLKSFVAGLQLGLLHEVTEGGDNLSIGQRQLLCLGRAVLRKSKILVLDEATAAVDLETDSLIQTTIRNEFSQCTVITIAHRLHTIMDSDKIMVLDSGKIVEYGSPEELLSNMGPFYLMAKEAGIESVNHTEL

SEQ ID NO: 3439 - protein, 145 aa, Mus musculus
YQRVIEACALLPDLEMLPGGDMAEIGEKGINLSGGQKHRVSLARATYQDADIYILDDPLSAVDTHVGKHIFNKVVGPNGLLSGKTRILVTHGIHFLPQVDEIVVLGKGTILEKGSYSDLMDKKGVFAKNWKTFMKHSGPEGEATV

SEQ ID NO: 3440 - protein, 55 aa, Mus musculus
LLSGKTRILVTHGIHFLPQVDEIVVLGKGTILEKGSYSDLMDKKGVFAKNWKTFM

SEQ ID NO: 3441 - protein, 337 aa, Cricetulus griseus
MSGSPVKRQRMESALDQLKQFTTVVADTGDFNAIDEYKPQDATTNPSLILAAAQMPAYQELVEEAIAYGKKLGGPQEEQIKNAIDKLFVLFGAEILKKIPGRVSTEVDARLSFDKDAMVARAKRLIELYKEAGISKDRILIKLSSTWEGIQAGKELEEQHGIHCNMTLLFSFAQAVACAEAGVTLISPFVGRILDWHVANTDKKSYEPQEDPGVKSVTKIYNYYKKFGYKTIVMGASFRNTGEIKALAGCDFLTISPKLLGELLKDNTKLAPVLSIKAAQTSDLGKIHLDEKAFRWLHSEDQMAVEKLSDGIRKFAADAIKLERMLTERMFSAENGK

SEQ ID NO: 3442 - protein, 110 aa, Rattus norvegicus
IDYKCHLKKHNERQFFLELVKDISNDLDLTSLSYKILIFVCLMVDADRCSLFLVEGAAAGKKTLVSKFFDVHAGTPLLPCSTTENSNEVQVPWGKGIIGYVGEHGETVNI

SEQ ID NO: 3443 - protein, 110 aa, Rattus norvegicus
KCHLKKHNERQFFLELVKDISNDLDLTSLSYKILIFVCLMVDADRCSLFLVEGAAAGKKTLVSKFFDVHAGTPLLPCSTTENSNEVQVPWGKGIIGYVGEHGETVNIPDA

SEQ ID NO: 3444 - protein, 99 aa, Oryza sativa
PNRQIADEELSTYKLECSSERTDKSCIKVWLEKHKKLHTALLIMVLIGTCMVIGDGVLTPAISVFSAVSGLEFSLSKDHREYAVIPITCVILAFLFALQ

SEQ ID NO: 3445 - protein, 83 aa, Oryza sativa
YKLECSSERTDKSCIKVWLEKHKKLHTALLIMVLIGTCMVIGDGVLTPAISVFSAVSGLEFSLSKDHREYAVIPITCVILAFL

SEQ ID NO: 3446 - protein, 479 aa, Craterostigma plantagineum
MSQVDAEGVVDGLRRTYISGKTKSYEWRVSQLKALLKITTHHDKEVVEALRADLKKPEHEAYVHEIFMVSNACKSALKELHQWMKPQKVKTSLATYPSSAEIVSEPLGVVLVITAWNYPFLLALDPMIGAIAAGNCVVLKPSEIAPATSALLAKLLNQYVDTSAIRVVEGAVPEMQALLDQRWDKIFYTGSSKVGQIVLSSAAKHLTPVVLELGGKCPTVVDANIDLKVAARRIISWKWSGNSGQTCISPDYIITTEENAPKLVDAIKCELESFYGKDPLKSQDMSSIINERQFERMTGLLDDKKVSDKIVYGGQSDKSNLKIAPTILLDVSEDSSVMSEEIFGPLLPIITVGKIEECYKIIASKPKPLAAYLFTNDKKRTEEFVSNVSAGGITINDIALHFLEPRLPFGGVGESGMGSYHGKFSFDAFSHKKSVLKRSFGGEVAARYPPYAPWKLHFMEAILQGDIFGLLKAWLGWSS

SEQ ID NO: 3447 - protein, 167 aa, Craterostigma plantagineum
QLKALLKITTHHDKEVVEALRADLKKPEHEAYVHEIFMVSNACKSALKELHQWMKPQKVKTSLATYPSSAEIVSEPLGVVLVITAWNYPFLLALDPMIGAIAAGNCVVLKPSEIAPATSALLAKLLNQYVDTSAIRVVEGAVPEMQALLDQRWDKIFYTGSSKVGQI

SEQ ID NO: 3448 - protein, 154 aa, Craterostigma plantagineum
LKITTHHDKEVVEALRADLKKPEHEAYVHEIFMVSNACKSALKELHQWMKPQKVKTSLATYPSSAEIVSEPLGVVLVITAWNYPFLLALDPMIGAIAAGNCVVLKPSEIAPATSALLAKLLNQYVDTSAIRVVEGAVPEMQALLDQRWDKIFYT

SEQ ID NO: 3449 - protein, 233 aa, Scenedesmus vacuolatus
LAIPPFNYPVNLAVSKLAPALMAGNTVVLKPPSQGVVAGIHMIKCFQAAGLPAGTVNLVTGKGSEIGDFLTTHPAVNCISFTGGDTGIAISRKAGMVPLQMELGGKDACIVCSDADLDLAATHIIKGGFSYSGQRCTAVKVVLVMQDIADELVRKVHAGVQKLKVGRPEDNADITAVVSEGSANFIQGLVEDAKAKGATFLTDWKREGNLLWPVLLDNVTADMRIAWEEPFGP

SEQ ID NO: 3450 - protein, 30 aa, Arabidopsis thaliana
LVYFNAKVMHLVMEETKNGSILSTSDWKLI

SEQ ID NO: 3451 - protein, 84 aa, Arabidopsis thaliana
YFNAKVMHLVMEETKNGSILSTSDWKLILPELYKHYPDNKMVLNMSVTSPPAVKITENGIDATIQLDIAFDVQDSGENLSVARL

SEQ ID NO: 3452 - protein, 417 aa, Arabidopsis thaliana
MDFCWKREMEGKLAHDHRGMTSPRRICVVTGPVIVGAGPSGLATAACLKERGITSVLLERSNCIASLWQLKTYDRLHLHLPKQFCELPIIPFPGDFPTYPTKQQFIEYLEDYARRFDIKPEFNQTVESAAFDENLGMWRVTSVGEEGTTEYVCRWLVAATGENAEPVVPRFEGMDKFAAAGVVKHTCHYKTGGDFAGKRVLVVGCGNSGMEVCLDLCNFGAQPSLVVRDAVHVLPREMLGTSTFGLSMFLLKWLPIRLVDRFLLVVSRFILGDTTLLGLNRPRLGPLELKNISGKTPVLDVGTLAKIKTGDIKVCSGIRRLKRHEVEFDNGKTERFDAIILATGYKSNVPSWLKENKMFSKKDGFPIQEFPEGWRGECGLYAVGFTKRGISGASMDAKRIAEDIHKCWKQDEQVKKI

SEQ ID NO: 3453 - protein, 424 aa, Arabidopsis thaliana
MAVEYVCCSPNFFIHIAVIVFLVLFAGLMSGLTLGLMSLSLVDLEVLAKSGTPEHRKYAAKILPVVKNQHLLLVTLLICNAAAMETLPIFLDGLVTAWGAILISVTLILLFGEIIPQSICSRYGLAIGATVAPFVRVLVFICLPVAWPISKLLDFLLGHRRAALFRRAELKTLVDFHGNEAGKGGELTHDETTIIAGALELSEKMVKDAMTPISDIFVIDINAKLDRDLMNLILEKGHSRVPVYYEQPTNIIGLVLVKNLLTINPDEEIPVKNVTIRRIPRVPEILPLYDILNEFQKGLSHMAVVVRQCDKIHPLPSKNGSVKEARVDVDSEGTPTPQERMLRTKRSLQKWKSFPNRASSFKGGSKSKKWSKDNDADILQLNGNPLPKLAEEEEAVGIITMEDVIEELLQEEIFDETDHHFEDS

SEQ ID NO: 3454 - protein, 174 aa, Arabidopsis thaliana
ADLILVMKDGKITQAGKYHEILDSGTDFMELVGAHTEALATIDSCETGYASEKSTTDKENEVLHHKEKQENGSDNKPSGQLVQEEEREKGKVGFTVYKKYMALAYGGAVIPLILVVQVLFQLLSIGSNYWMTWVTPVSKDVEPPVSGFTLILVYVLLAVASSFCILIRALLVAM

SEQ ID NO: 3455 - protein, 171 aa, Arabidopsis thaliana
ILVMKDGKITQAGKYHEILDSGTDFMELVGAHTEALATIDSCETGYASEKSTTDKENEVLHHKEKQENGSDNKPSGQLVQEEEREKGKVGFTVYKKYMALAYGGAVIPLILVVQVLFQLLSIGSNYWMTWVTPVSKDVEPPVSGFTLILVYVLLAVASSFCILIRALLVAM

SEQ ID NO: 3456 - protein, 363 aa, Catharanthus roseus
MGSANPDNKNSMTKEEEEACLSAMRLASASVLPMVLKSAIELDLLELIKKSGPGAYVSPSELAAQLPTQNPDAPVMLDRILRLLASYSVLNCTLKDLPDGGIERLYSLAPVCKFLTKNEDGVSMAALLLMNQDKVLMESWYHLKDAVLEGGIPFNKAYGMTAFEYHGKDPRFNKVFNQGMSNHSTIIMKKILEIYQGFQGLKTVVDVGGGTGATLNMIVSKYPSIKGINFDLPHVIEDAPSYPGVDHVGGDMFVSVPKGDAIFMKWICHDWSDAHCLKFLKNCHEALPENGKVILAECLLPEAPDSTLSTQNTVHVDVIMLAHNPGGKERTEKEFEALAKGAGFRGFIKVCCAYNSWIMELLK

SEQ ID NO: 3457 - protein, 100 aa, Arabidopsis thaliana
LLFHYLKVLELEDAVSQMKIIHVAGTKGKGSTCTFAESILRCYGLRTGLFTSPHLIDVRERFRLNGIEISQEKFVNYFWCCFHKLKEKTSNEVDVVILEV

SEQ ID NO: 3458 - protein, 152 aa, Arabidopsis thaliana
LLFHYLKVLELEDAVSQMKIIHVAGTKGKGSTCTFAESILRCYGLRTGLFTSPHLIDVRERFRLNGIEISQEKFVNYFWCCFHKLKEKTSNEVDVVILEVGLGGRFDATNVIQKPVVCGISSLGYDHMEILGYTLAEIAAEKAGIFKSGVPA

SEQ ID NO: 3459 - protein, 555 aa, Arabidopsis thaliana
MAEPEVIHSWSAPRSLSTSLMYSFAQRLDTEVVDEPLYASFLKATGFDRPYRDEVLSKMECNGEKVVKDVIYGSGSKKYRYCKHISKQRLFGLPSELMSRGKHFILIRNPLNILPSFEKVHPPSFLELGLGELVSIYSDLCQMGTPPAVIDADELQRDPETTLRGLCDDLEIPFQASMLKWKAGPIPEDGVWAPWWYKSVHESTGFSSPKKYPRTFPLSHYDLLERSLPLYNILRSHVKHSSSLLSSPLPPPSLPVPENAKLLAWVGDEILPREMAKVSVFDSVVQGGDSVWEGLRIYKGKIFKLEEHLDRLFDSAKALAFDNVPAREEVKEAIFRTLITNGMFDNTHIRLSLTRGKKVTSGMSPAYNRYGCTLIVLAEWKPPVYDNEGGIVLVTATTRRNSPNNLDSKIHHNNLLNNILAKIESNNTNAADAIMLDKDGYVSETNATNIFMVKKGCVLTPHADYCLPGITRATVMELVVKENFILEERRISLSEFHTANEVWTTGTMGELSPVVKIDGRVIGDGKVGPVTRTLQNAYKKLTEDSGVPIPTYQEP

SEQ ID NO: 3460 - protein, 726 aa, Oryza sativa
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 3461 - protein, 364 aa, Arabidopsis thaliana
MTKSHVIFSASIALFLLLSISHFPGALSQSNKDCQSKSNYSCIDKNKALDLKLLSIFSILITSLIGVCLPFFARSIPAFQPEKSHFLIVKSFASGIILSTGFMHVLPDSFEMLSSPCLNDNPWHKFPFAGFVAMMSAVFTLMVDSITTSVFTKSGRKDLRADVASVETPDQEIGHVQVHGHVHSHTLPHNLHGENDKELGSYLQLLRYRILAIVLELGIVVQSIVIGLSVGDTNNTCTIKGLVAALCFHQMFEGMGLGGCILQAEYGWVKKAVMAFFFAVTTPFGVVLGMALSKTYKENSPESLITVGLLNASSAGLLIYMALVDLLAADFMGQKMQRSIKLQLKSYAAVLLGAGGMSVMAKWA

SEQ ID NO: 3462 - protein, 365 aa, Arabidopsis thaliana
MAYSKACYKLTTITILLLSFTLPSLAGNAENADVSECKAESGDLSCHNNKEAQKLKIIAIPSILVASMIGVSLPLFSRSIPALGPDREMSVIVKTLASGVILATGFMHVLPDSFDDLTSKCLPEDPWQKFPFATFITMISALLVLMIESFAMCAYARRTSKREGEVVPLENGSNSVDTQNDIQTLENGSSYVEKQEKVNEDKTSELLRNKVIAQILELGIVVHSVVIGLAMGASDNKCTVQSLIAALCFHQLFEGMGLGGSILQAQFKSKTNWTMVFFFSVTTPFGIVLGMAIQKIYDETSPTALIVVGVLNACSAGLLIYMALVNLLAHEFFGPKIQGNIKLHVLGYVATFTGAAGMSLMAKWA

SEQ ID NO: 3463 - protein, 907 aa, Arabidopsis thaliana
MAGELVSFGIKKLWDLLSQECEQFQGVEDQVTGLKRDLNLLSSFLKDADAKKHTTAVVRNVVEEIKEIVYDAEDIIETYLLKEKLWKTSGIKMRIRRHACIISDRRRNALDVGGIRTRISDVIRDMQSFGVQQAIVDGGYMQPQGDRQREMRQTFSKDYESDFVGLEVNVKKLVGYLVDEENVQVVSITGMGGLGKTTLARQVFNHEDVKHQFDRLAWVCVSQEFTRKNVWQMILQNLTSREKKDEILQMEEAELHDKLFQLLETSKSLIVFDDIWKDEDWDLIKPIFPPNKGWKVLLTSQNESVAVRGDIKYLNFKPECLAIEDSWTLFQRIAFPKKDASESKVDEEMEDMGKQMLKHCGGLPLAIKVLGGLLAAKYTMHDWERLSVNIGSDIVGRTSSNNSSIYHVLSMSFEELPSYLKHCFLYLAHFPEDHKINVEKLSYCWAAEGISTAEDYHNGETIQDVGQSYLEELVRRNMIIWERDATASRFGTCHLHDMMREVCLFKAKEENFLQIAVKSVGVTSSSTGNSQSPCRSRRLVYQCPTTLHVERDINNPKLRSLVVLWHDLWVENWKLLGTSFTRLKLLRVLDLFYVDFEGMKLPFGIGNLIHLRYLSLQDAKVSHLPSSLGNLMLLIYLNLDVDTEFIFVPDVFMRMHELRYLKLPLHMHKKTRLSLRNLVKLETLVYFSTWHSSSKDLCGMTRLMTLAIRLTRVTSTETLSASISGLRNLEYLYIVGTHSKKMREEGIVLDFIHLKHLLLDLYMPRQQHFPSRLTFVKLSECGLEEDPMPILEKLLHLKGVILLKGSYCGRRMVCSGGGFPQLKKLEIVGLNKWEEWLVEEGSMPLLETLSILDCEELKEIPDGLRFIYSLELVMLGTRWKKKFSVGGEDYYKVQHIPSVEFIGGYLK

SEQ ID NO: 3464 - protein, 528 aa, Macaca fascicularis
MSMKWTSALLLIQLSCYLSSGNCGKVLVWPTEFSHWMNIKTILDELVQRGHEVTVLAYSPSILPGPNNPSALKFEICPTSLTETEFEDSVTQLVKRWSDIPKDTFWPHFLQVQEMMWTYGDMIRKFCKDVVSNKKLMKKLQESRFDVVLADAISPCGELLAELLKIPFVYSLRFSPGYAIEKHGGGFLFPPSYVPVVMSEFSDQMTFMERVKNMIYMVYFDFWFQAWDTKKWDQFYSEVLGRPTTLFETMAKAEIWLIRNYWDFQFPHPLLPHVELVGGLHCKPAKPLPKEMEGFVQSSGDNGVVVFSLGSMVSNMSEERANVIASALAKIPQKVLWRFDGNKPDTLGLNTQLYKWLPQNDLLGHPKTRAFITHGGANAIYEAIYHGIPMVGVPLFADQLDNIAHMKAKGARVSLDFNTMSSTDLLHALKTVINDPFYKENAMKLSSIHHDQPVKPLDRAVFWIEFVMRHKGAKHLRVAAYDLTWFQYHSLDVIGFLLACVATVIFIITKCLFCVLKFVRTGKKGKRD

SEQ ID NO: 3465 - protein, 126 aa, Macaca fascicularis
GIPMVGVPLFADQLDNIAHMKAKGARVSLDFNTMSSTDLLHALKTVINDPFYKENAMKLSSIHHDQPVKPLDRAVFWIEFVMRHKGAKHLRVAAYDLTWFQYHSLDVIGFLLACVATVIFIITKCL

SEQ ID NO: 3466 - protein, 51 aa, Macaca fascicularis
KHLRVAAYDLTWFQYHSLDVIGFLLACVATVIFIITKCLFCVLKFVRTGKK

SEQ ID NO: 3467 - protein, 57 aa, Drosophila yakuba
MKYFSVLVVLTLILAISVGQSNAIFVDVLDNVETALHNAAKAGFKLIKPIEKLIMPK

SEQ ID NO: 3468 - protein, 62 aa, Drosophila teissieri
MKYFSVLVVLTLILAIVDQSDAFINLLDKVEDALHTGAQAGFKLIRPVERGATPKKSEKPEK

SEQ ID NO: 3469 - protein, 298 aa, Listeria monocytogenes
MNNLQTKFPHIAIKLNEPLSKYTYTKTGGAADVFVMPKTIEEAQEVVAYCHQNKIPLTILGNGSNLIIKDGGIRGVILHLDLLQTIERNNTQIVAMSGAKLIDTAKFALNESLSGLEFACGIPGSIGGALHMNAGAYGGEISDVLEAATVLTQTGELKKLKRSELKAAYRFSTIAEKNYIVLDATFSLALEEKNLIQAKMDELTAAREAKQPLEYPSCGSVFKRPPGHFAGKLIQDSGLQGHIIGGAQVSLKHAGFIVNIGGATATDYMNLIAYVQQTVREKFDVELETEVKIIGEDK

SEQ ID NO: 3470 - protein, 266 aa, Listeria monocytogenes
MKQAIGFIDSGVGGLTVVREVLKQLPHEQVYYLGDTARCPYGPRDKEEVAKFTWEMTNFLVDRGIKMLVIACNTATAAALYDIREKLDIPVIGVIQPGSRAALKATRNNKIGVLGTLGTVESMAYPTALKGLNRRVEVDSLACPKFVSVVESGEYKSAIAKKVVAESLLPLKSTKIDTVILGCTHYPLLKPIIENFMGDGVAVINSGEETASEVSALLDYHNLLDATDEEIEHRFFTTGSTQIFKDIAKDWLNMPDMTVEHIKLGK

SEQ ID NO: 3471 - protein, 880 aa, Listeria monocytogenes
MEIYRKSAAETFTQLEATEKGLTTSEVTKRQEKYGFNELKNKKKDPLWKLFLETFKDPMVIVLVIAALVQLVLGEVVESLIIFLVLIVNSIISVVQTRKAESSLDALREMSAPVAKVIRDGSKQSIHARELVPGDVVILDAGDFVPADGRLFESGSLKIDEGMLTGESEAVEKYIDTIPDEVGLGDRVNMVFSGSLVVYGRGMFVVTGTASETEIGKIAGLLETAEAKQTPLQRKLESFSKKLGLGILALCVLIFAVEAGRVLLGDNSADMATAILNAFMFAVAVAVAAIPEALSSIVTIVLAVGTNKMAKQHAIIRKLPAVETLGSTSVICTDKTGTLTQNKMTVVDYYLPDGTKENFPESPENWSEGERRLIHIAVLCNDSNINSEGKELGDPTEVALIAFSNKNNQDYNEIREKFIREGEIPFDSDRKLMSTLHTFNENKAMLTKGGPDVMFARCSYVFLDGEEKPMTEEILAKLKETNEEFSNQALRVLAYGYKRMPADTTELKLEDEQDIVLVGLTAMIDPPREAVYASIEESKKAGIRTVMITGDHKTTAQAIGRDIGLMDADDIALTGQELDAMPEEELDKKLEHIAVYARVSPENKIRIVKAWQKKGKITAMTGDGVNDAPALKQADIGVAMGSGTDVAKDSAAMILTDDNFVSIVDAVGVGRTVFDNIKKSIAYLFAGNLGAIIAILFALVLDWINPFTALQLLFINLVNDSLPAIALGMEKAEPDVMKRKPRDINEGIFAGGTMRAVISRGVLIGIAVIISQYIGMQISPEMSVAMAFTTLILARTLQTFAARSNVQTAFGAGFFSNKYVIGAVLLCFVLYGITVLPGAREIFSIPASFGLHEWSIAAGLALAAVVMMEIIKVVQNKFFK

SEQ ID NO: 3472 - protein, 400 aa, Nostoc sp.
MSKKTVASLSAADISGKRALVRVDFNVPLDDQGNITDDTRIRAALPTIQDLTQKGAKVILASHFGRPKGVDEKLRLTPVAKRLSELLGQEVIKTDDSIGDEVAAKVATLQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIENIPDGWMGLDIGPDSVKVFQAALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 3473 - protein, 159 aa, Yersinia pestis
MITKAIYPGTFDPITNGHLDLVTRASAMFSHVILAIADSSSKKPMFTLDERVALAKKVTAPLKNVEVLGFSELMAEFAKKHNANILVRGLRSVSDFEYEWQLANMNRHLMPKLESVFLIPSEKWSFISSSLVKEVARHGGDITPFLPKPVTKALLAKLA

SEQ ID NO: 3474 - protein, 288 aa, Salmonella typhimurium
MDVTAKYELIGLMAYPIRHSLSPEMQNKALEKAGLPYTYMAFEVDNTTFASAIEGLKALKMRGTGVSMPNKQLACEYVDELTPAAKLVGAINTIVNDDGYLRGYNTDGTGHIRAIKESGFDMRGKTMVLLGAGGAATAIGAQAAIEGIKEIKLFNRKDDFFEKAVAFAKRVNENTDCVVTVTDLADQHAFTEALASADILTNGTKVGMKPLENESLIGDVSLLRPELLVTECVYNPHMTKLLQQAQQAGCKTIDGYGMLLWQGAEQFELWTGKAFPLDYVKQVMGFTA

SEQ ID NO: 3475 - protein, 199 aa, Columba livia
VKATNEIGSNVSDPLYVDVTYIVQTDPPVNVTLELKKTVNRKPYLVLTWSPPPLADVRSGWLTLDYELRLKPEEAEEWETIFVGQQTHYKMFSLNPGKKYIVQIHCKPDHHGSWSEWSLEKYLQIPTDFRIKDMVVWIIVGVLSSLICLVMSWTMVLKGYRMIAFILPPVPGPKIKGIDTHLLETGKSEELLSALGCHG

SEQ ID NO: 3476 - protein, 128 aa, Columba livia
VTLELKKTVNRKPYLVLTWSPPPLADVRSGWLTLDYELRLKPEEAEEWETIFVGQQTHYKMFSLNPGKKYIVQIHCKPDHHGSWSEWSLEKYLQIPTDFRIKDMVVWIIVGVLSSLICLVMSWTMVLK

SEQ ID NO: 3477 - protein, 143 aa, Danio rerio
MSLSDTDKAVVKAIWAKISPKADEIGAEALARMLTVYPQTKTYFSHWADLSPGSGPVKKHGKTIMGAVGEAISKIDDLVGGLAALSELHAFKLRVDPANFKILSHNVIVVIAMLFPADFTPEVHVSVDKFFNNLALALSEKYR

SEQ ID NO: 3478 - protein, 160 aa, Gallus gallus
MKTLNVLALVLVLLCINASTEWPTHTVCKEENLEIYYKSCDPQQDFAFSIDRCSDVTTHTFDIRAAMVLRQSIKELYAKVDLIINGKTVLSYSETLCGPGLSKLIFCGKKKGEHLYYEGPITLGIKEIPQRDYTITARLTNEDRATVACADFTVKNYLDY

SEQ ID NO: 3479 - protein, 31 aa, Gallus gallus; identical to SEQ ID NO: 43

SEQ ID NO: 3480 - protein, 105 aa, Gallus gallus
LAISLVAKEKEKVWYHVCSSRGKGCYNTRLKEEGGCTIWYNEMQLLGEIEEHLNCTISQVEPDIKVPVDDFDGKVTYGQKRALGGGLYKGHVDILAPTVQELAAL

SEQ ID NO: 3481 - protein, 2242 aa, Squalus acanthias
MATLFLDDGSSFKGRLFGASSTVSGEVVFQTGMVGYPEALTDPSYLSQILVLTYPLIGNYGIPKDEEDEHGLSKWFESAKIHAAALVIGENSQNPSHWSSVRSLDQRLKEHGIPALEGIDTRSLTKKIREKGTLLGKLVIDGTDENSLPYDDPNKRHLVKEVSIKEPKVYHPSGNVKIMAVDCGMKYNQIRSLCKRGAAVTVVPWDYLFDSNEFDGLFISNGPGDPEYCQQTINNVKKAISEEKPKPLFGICLGHQILSLAIGAKTYKMKYGNRGHNQPCIHEGTQRCFYTSQNHGFAVEPCSLPRDWSVLFTNANDQSNEGIIHNSKPLFSVQFHPEHKAGPTDLVDLFDIFLECARDVKLGVNLDKTVKGRVISHYSFKNGTENSKTPPGRIQPHKVLILGSGGLSIGQAGEFDYSGSQAIKALKEENVQSVLINPNIATVQTSKGLADKVYFLPITPEYVTQVIMNERPDGILLTFGGQTALNCGVELQKRGVLEKYHVRVLGTPVSSIEMTEDRKIFVEKMAEINEYVVPSEAAFTLEQAQGAAERLGYPVLVRAAFALGGLGSGFAQNKEELVTLVTQAFAHTSQILVDKSLKGWKEIEYEVVRDAYDNCITVCNMENVDPLGIHTGESIVVAPSQTLNDKEYNLLRTTAIKVIRHLGVVGECNIQYALSPESEQYFIIEVNARLSRSSALASKATGYPLAYVAAKLALGIPLPVLRNSVTNSTTANYEPSLDYCVVKVPRWDLSKFLRLSTKIGSSMKSVGEVMAIGRNFEEAFQKALRMVDENCVGFDHTLKPASDEELETPTDKRIFVLAAALRAGYEIDRLYELTKIDKWFLHKMKNIVEYSLKLSELYMKDEVPRHDLLKVKRLGFSDKQIAMAIQSTELAVRRLRQEWKILPVVKQIDTVAAEWPAQTNYLYLTYNGEGHDLDFTKPHVMVIGSGVYRIGSSVEFDWCAVRCIQQLRKMGYKTRMVNYNPETVSTDYDMCDRLYFDEISFEVVMDIYELENPEGIILSMGGQLPNNIAMDLHRQQCRILGTSPESIDTAENRFKFSRMLDTIGISQPRWKELSDTESSKQFCTKVGYPCLIRPSYVLSGVAMNVAYSDNDLEKFLSSAVAVSKEHPVVISKFIQEAKEIDVDAVACDGVVIAVAISEHVENAGVHSGDATLVTPPQDLNQKTTERIKAIVHAIGQELQATGPFNLQLIAKDDQLKVIECNVRVSRSFPFVSKTLGVDMIALATKVIMGEEVEPVGLMTGTGVVGVKVPQFSFSRLAGADVVLGVEMTSTGEVACFGENRYEAYLKAMLSTGFKIPKKNILLSIGSYKNKSELLSTVQSLEQLGYNLYASLGTADFYTEHGVKIKAVDWPFEDTDNGCPLKERHRNIMDYLEENHFDLVINLSMRNSGGRRLSSFVTKGYRTRRLAVDYSVPLIIDIKCTKLFVEALRLVGDTPPVKTHIDSMSSHKLIRLPGLIDVHVHLREPGGTHKEDFASGTAAALAGGVTMVCAMPNTNPAITDQTSFALVQKLATAGARCDFALFLGASSDNADVLPLISNSAAGLKMYLNDTFSTLKMDNVSLWMEHFEKWPKHLPIVVHAERQTVAAILMVAQLYQRPVHICHVARKEEIQIIRAAKQKGVQVTCEVAPHHLFLNEEDLESIGHGKGQVRPMLSTKEDVNALWENLDVIDCFATDHAPHSVEEKNSDSPPPGYPGLETMLPLLLTAVSEGRLTIDDLVKRLYENPRKIFSLPVQENTYVEVDLEQEWIIPSYMQFTKSKWTPFEGKKVKGRVRRVVLRGEVAYIDGQVLVPPGYGQDVRAWPLGVPLPPPPTTVKTPEHSKPTQTETVRTRTASPRRLASSGPAVDARFHLPPRIHRCSDPGLPNAEGEYKEKPVKKFIEQDTVSQDGYIYPPPVSRLLSPQNLAAQAVPHPYSLLLHPFVGQHILSVKRFTKDQLSHLFNVAHNLRLTVQKDRSLDILKGKVMASMFYEVSTRTSSSFRAAMHRLGGSVIHFSEATSSVQKGESLLDSVQTMSCYVDVVVLRHPEPGAVELAAKHSRKPIINAGDGVGEHPTQALLDIFTIREELGTVNGMTITMVGDLKHGRTVHSLAYLLTLYRVNLRYVTPRNLRMPPNIIRFLASRGIKQEEFDSLEEALPDTDVLYMTRIQKERFASEEEYEACFGQFILTPHIMTKGKKKMVVMHPLPRVNEVSVEVDSDPRAAYFRQAENGMYVRMALLATVLGKF

SEQ ID NO: 3482 - protein, 319 aa, Xenopus laevis
MSKEMKGQYEPVAEIGVGAYGTVYKARDLQSGKFVALKNVRVQTNENGLPLSTVREVTLLKRLEHFDHPNIVKLMDVCASARTDRETKVTLVFEHVDQDLKTYLSKVPPPGLPLETIKDLMKQFLSGLEFLHLNCIVHRDLKPENILVTSGGQVKLADFGLARIYSCQMALTPVVVTLWYRAPEVLLQSTYATPVDVWSAGCIFAEMFKRKPLFCGNSEADQLCKIFDIIGLPSEEEWPVDVTLPRSAFSPRTQQPVDKFVPEIDAMGADLLLAMLTFSPQKRISASDALLHPFFADDPQACSKQEHFTHICTATDEVK

SEQ ID NO: 3483 - protein, 52 aa, Xenopus laevis
DDALSSTLVQFKHHNEEEWKWKFEDSFGVDVYTLFMLILCVLCLVKLIATEI

SEQ ID NO: 3484 - protein, 46 aa, Xenopus laevis
TLVQFKHHNEEEWKWKFEDSFGVDVYTLFMLILCVLCLVKLIATEI

SEQ ID NO: 3485 - protein, 182 aa, Xenopus laevis
STIDVNDLKKNGTVQCVASNEVESAYSVFSFAIKEKLRTHTLFTPLLIGFIAAAGLMCIAVAVLMYKYLQKPKYEIQWKVVEEINGNNYVYIDPTQLPYDNKWEFPRDRLCFGKILGAGAFGKVVEATAYGLLKEDSRLTVAVKMLKPSAHSTEREALMSELKVLSYLGHHKNIVNLLGACT

SEQ ID NO: 3486 - protein, 151 aa, Xenopus laevis
HTLFTPLLIGFIAAAGLMCIAVAVLMYKYLQKPKYEIQWKVVEEINGNNYVYIDPTQLPYDNKWEFPRDRLCFGKILGAGAFGKVVEATAYGLLKEDSRLTVAVKMLKPSAHSTEREALMSELKVLSYLGHHKNIVNLLGACTVGGPTLVI

SEQ ID NO: 3487 - protein, 61 aa, Mus musculus; identical to SEQ ID NO: 2762

SEQ ID NO: 3488 - protein, 69 aa, Mus musculus; identical to SEQ ID NO: 2763

SEQ ID NO: 3489 - protein, 168 aa, Mus musculus
GEGLGVFQQSSKHSLFDSCKMSRGGPFTEDKVEDVKALVKIVPVFLALIPYWTVYFQMQTTYALQSLHLKIPEISSITTTHHTLPAAWLTMFDAVLILLLIPLKDKLVDPVLRRHGLLPSSLKRIAVGMFFVMCSAFAAGILESKRLDLVKEKTINQTIGGVVYHAAD

SEQ ID NO: 3490 - protein, 123 aa, Mus musculus
KVEDVKALVKIVPVFLALIPYWTVYFQMQTTYALQSLHLKIPEISSITTTHHTLPAAWLTMFDAVLILLLIPLKDKLVDPVLRRHGLLPSSLKRIAVGMFFVMCSAFAAGILESKRLDLVKEK

SEQ ID NO: 3491 - protein, 697 aa, Mus musculus
MQTQEILRILRLPELSDLGQFFRSLSATTLVSVGALAAVLAYWLTHRPKALQPPCNLLKQSEEVEDGGGARRSVIGGCTQLLTHYYDDARTMYQVFRRGLSISGNGPCLGFRKPEQPYQWLSYQEVAKRAEFLGSGLLQHDCKVGTEQFVGVFAQNRPEWIIAELACYTYSMVVVPLYDTLGPGSISYIINTADICTVIVDKPHKATLLLEHVERKETPGLKLVILMEPFEDALRERGKKCGVDIKSMQAIEDCGRENHHAPVPPRPDDLSIVCFTSGTTGNPKGAMLTHGNVVADFSGFLKVTEKVIFPRQDDVLISFLPLAHMFERVIQSVVYCHGGRVGFFQGDIRLLSDDMKALRPTIFPVVPRLLNRMYDKIFHQADTSLKRWLLEFAAKRKQAEVRSGIIRNNSIWDELFFNKIQASLGGHVRMIVTGAAPASPTVLGFLRAALGCQVYEGYGQTECTAGCTFTTPGDWTSGHVGAPLPCNHIKLVDAEELNYWTCKGEGEICVKGPNVFKGYLKDEDRTKEALDSDGWLHTGDIGKWLPEGTLKIIDRKKHIFKLAQGEYVAPEKIENIYIRSEPVAQIYVHGDSLKAFLVGIVVPDPEVMPSWAQKKGIEGTYQELCMKKELKKAILDDMVMLGKESGLHSFEQVKAIYIHCDMFSVQNGLLTPTLKAKRPELREYFKKQIEELYLVSV

SEQ ID NO: 3492 - protein, 722 aa, Mus musculus
MLTFFLVSGGSLWLFAEIALSLLEKMQTQEILRILRLPELSDLGQFFRSLSATTLVSVGALAAVLAYWLTHRPKALQPPCNLLKQSEEVEDGGGARRSVIGGCTQLLTHYYDDARTMYQVFRRGLSISGNGPCLGFRKPEQPYQWLSYQEVAKRAEFLGSGLLQHDCKVGTEQFVGVFAQNRPEWIIAELACYTYSMVVVPLYDTLGPGSISYIINTADICTVIVDKPHKATLLLEHVERKETPGLKLVILMEPFEDALRERGKKCGVDIKSMQAIEDCGRENHHAPVPPRPDDLSIVCFTSGTTGNPKGAMLTHGNVVADFSGFLKVTEKVIFPRQDDVLISFLPLAHMFERVIQSVVYCHGGRVGFFQGDIRLLSDDMKALRPTIFPVVPRLLNRMYDKIFHQADTSLKRWLLEFAAKRKQAEVRSGIIRNNSIWDELFFNKIQASLGGHVRMIVTGAAPASPTVLGFLRAALGCQVYEGYGQTECTAGCTFTTPGDWTSGHVGAPLPCNHIKLVDAEELNYWTCKGEGEICVKGPNVFKGYLKDEDRTKEALDSDGWLHTGDIGKWLPEGTLKIIDRKKHIFKLAQGEYVAPEKIENIYIRSEPVAQIYVHGDSLKAFLVGIVVPDPEVMPSWAQKKGIEGTYQELCMKKELKKAILDDMVMLGKESGLHSFEQVKAIYIHCDMFSVQNGLLTPTLKAKRPELREYFKKQIEELYLVSV

SEQ ID NO: 3493 - protein, 120 aa, Mus musculus
GSVPLFWSQDISTMMPKPPITLDQADPFAHVAALHFDQMLQRFGSPIIILNLVKEREKRKHERILSEELVAAVTYLNQFLPPEHTIVYIPWDMAKYTKSKLCNVLDRLNVIAESVVKKTG

SEQ ID NO: 3494 - protein, 31 aa, Mus musculus
LPPEHTIVYIPWDMAKYTKSKLCNVLDRLNV

SEQ ID NO: 3495 - protein, 418 aa, Mus musculus
MAFIAALGLLMAGICPAVLCFPDGTLGMDAAVQEDHDNGTQLDSLTLASINTDFAFSLYKELVLKNPDKNIVFSPLSISAALAVMSLGAKGNTLEEILEGLKFNLTETSEADIHQGFGHLLQRLNQPKDQVQISTGSALFIEKRQQILTEFQEKAKTLYQAEAFTADFQQPRQAKKLINDYVRKQTQGMIKELVSDLDKRTLMVLVNYIYFKAKWKVPFDPLDTFKSEFYAGKRRPVIVPMMSMEDLTTPYFRDEELSCTVVELKYTGNASALFILPDQGRMQQVEASLQPETLRKWKNSLKPRMIDELHLPKFSISTDYSLEDVLSKLGIREVFSTQADLSAITGTKDLRVSQVVHKAVLDVAETGTEAAAATGVKFVPMSAKLYPLTVYFNRPFLIMIFDTETEIAPFIAKIANPK

SEQ ID NO: 3496 - protein, 547 aa, Mus musculus
MPSGTSQCEDGSAGGFQHLDMHSEKRQLEKGPSGDKDRVWIRPDTPSRCTWQLGRAMADSPHYHTVLTKSPKILPDILRKIGNTPMVRINKISKNAGLKCELLAKCEFFNAGGSVKDRISLRMIEDAERAGNLKPGDTIIEPTSGNTGIGLALAAAVKGYRCIIVMPEKMSMEKVDVLRALGAEIVRTPTNARFDSPESHVGVAWRLKNEIPNSHILDQYRNASNPLAHYDDTAEEILQQCDGKLDMLVASAGTGGTITGIARKLKEKCPGCKIIGVDPEGSILAEPEELNQTEQTAYEVEGIGYDFIPTVLDRAVVDKWFKSNDEDSFAFARMLIAQEGLLCGGSSGSAMAVAVKAARELQEGQRCVVILPDSVRNYMSKFLSDKWMLQKGFMKEELSVKRPWWWRLRVQELSLSAPLTVLPTVTCEDTIAILREKGFDQAPVVNESGAILGMVTLGNMLSSLLAGKVRPSDEVCKVLYKQFKPIHLTDTLGTLSHILEMDHFALVVHEQIQYCSNGMSSKQQMVFGVVTAIDLLNFVAAREQTQT

SEQ ID NO: 3497 - protein, 318 aa, Mus musculus
MAAHCRGTELDLSWISKVQVNHAAVLRRAQQIQARRSVKKEWQAAWLLKAVTFIDLTTLSGDDTFSNVQRLCYKAKYPIRADLLKALNMDDKGITTAAVCVYPARVCDAVKALKAAGCSIPVASVATGFPAGQTHLKTRLEEIRLAVEDGATEIDVVINRTLVLTGQWEALYDEVTQFRKACGEAHLKTILATGELGSLTNVYKASLVAMMAGSDFIKTSTGKETVNATFPVAIVMLRAIRDFFWKTGNKVGFKPAGGIRTAKESLAWLSLVKEELGDEWLTPDLFRIGASSLLSDIERQIYHHVTGRYAAYHDLPMS

SEQ ID NO: 3498 - protein, 110 aa, Mus musculus
KLSSLNKEVSTLQDTKVMTFKAIVQLFVLGCSWGIGLFIFIEVGKTVRLIVAYLFTIINVLQGVLIFMVHCLLNRQVRMEYKKWFHRLRKEVESESTEVSHSTTHTKMGL

SEQ ID NO: 3499 - protein, 121 aa, Mus musculus
LLKELVCKDVSYCRNKIGTYICSCVVKYPLFNWVAGIINIDHPDCYVNKSKNTGSKTHTLGVLSEFKSKEEVAKGATKLLRKVEHHILNENSDIPKKDENPLLDIVYETKRCKTMTLLEAG

SEQ ID NO: 3500 - protein, 405 aa, Rattus norvegicus
MVARWVKGSEDAPLALQKIPDLQSGPRSLRMEAIHIGMSSAPLVKHSNGVGLKAHRPRVMSKSGHSNVRIDKVDGIYLLYLQDLWTTVIDMKWRYKLTLFAATFVMTWFLFGVVYYAIAFIHGDLELGESNSNHTPCIMKVDSLTGAFLFSLESQTTIGYGVRSITEECPHAIFLLVAQLVITTLIEIFITGTFLAKIARPKKRAETIKFSHCAVISKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQKLEEQYRQEDQRERELRSLLLQQSNV

SEQ ID NO: 3501 - protein, 375 aa, Rattus norvegicus
MEAIHIGMSSAPLVKHSNGVGLKAHRPRVMSKSGHSNVRIDKVDGIYLLYLQDLWTTVIDMKWRYKLTLFAATFVMTWFLFGVVYYAIAFIHGDLELGESNSNHTPCIMKVDSLTGAFLFSLESQTTIGYGVRSITEECPHAIFLLVAQLVITTLIEIFITGTFLAKIARPKKRAETIKFSHCAVISKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQKLEEQYRQEDQRERELRSLLLQQSNV

SEQ ID NO: 3502 - protein, 861 aa, Mus musculus
MGEISQEAVERYLEKNPCFAKEYFDKKLRVEALGVIFKNSHAGVQTGLSLPEMTQVEESAVCLELLQCMQDEAGSAEQMAHRALQRLAQLLQADCCSMFSCRARNGIPEVASRLLNVTPTSKFEDNLVAPDREVVFPLDIGIVGWVAHVKKALNVSDVKKNSHFSDFMDKQTGYVTRNLLAVPIVAGKEVLAVVMAVNKISAPEFSKQDEEVFSKYLSFVAVALRLQHTSYLYSVESRRSQILMWSANKVFEELTDVERQFHKALYTIRTYLNCDRYSIGLLDMTKEKEFYDEWPIKLGEVEPYKGPKTPDGREIIFYKIIDYILHGKEEINVIPSPPADHWTLVSGLPTYVAENGFICNMLNAPADEYFTFQKGPVDETGWVIKNVLSLPIVNKKEDIVGVATFYNRKDGKPFDEHDEHITETLTQFLGWSLLNTDTYERVNKLESRKDIAQEMVMNLTKATPDEISSILKFKEKLNVEVIEECEERQLLAILKEDLPDPRTADLYEFCFSDFPITEHELVKCGLRLFLEINVVEKFKVPVEVLTRWMYTVRKGYRPVTYHNWRHGFNVGQTMFTLLMTGRLKKYYTDLEAFAMLAAAFCHDIDHRGTNNLYQMKSTSPLARLHGTSILERHHLEYSKTLLQDESLNIFQNLNKRQFETVIHLFEVAIIATDLALYFKKRTMFQKIVDTCEQMQSEEETIKYVTSDPTKKEVIMAMMMTACDLSAITKPWEVQSQVALLVANEFWEQGDLERTVLQQQPIPMMDRSKKDELPKLQVGFIDFVCTFVYKEFSRFHGEITPMLNGLQNNRVEWKSLAEEYEAKVKVTEEEAGKQEEEASDGKAATDLGGSAEDKKSKTCLML

SEQ ID NO: 3503 - protein, 836 aa, Mus musculus
MGEISQEAVERYLEKNPCFAKEYFDKKLRVEALGVIFKNSHAGVQTGLSLPEMTQVEESAVCLELLQCMQDEAGSAEQMAHRALQRLAQLLQADCCSMFSCRARNGIPEVASRLLNVTPTSKFEDNLVAPDREVVFPLDIGIVGWVAHVKKALNVSDVKKNSHFSDFMDKQTGYVTRNLLAVPIVAGKEVLAVVMAVNKISAPEFSKQDEEVFSKYLSFVAVALRLQHTSYLYSVESRRSQILMWSANKVFEELTDVERQFHKALYTIRTYLNCDRYSIGLLDMTKEKEFYDEWPIKLGEVEPYKGPKTPDGREIIFYKIIDYILHGKEEINVIPSPPADHWTLVSGLPTYVAENGFICNMLNAPADEYFTFQKGPVDETGWVIKNVLSLPIVNKKEDIVGVATFYNRKDGKPFDEHDEHITETLTQFLGWSLLNTDTYERVNKLESRKDIAQEMVMNLTKATPDEISSILKFKEKLNVEVIEECEERQLLAILKEDLPDPRTADLYEFCFSDFPITEHELVKCGLRLFLEINVVEKFKVPVEVLTRWMYTVRKGYRPVTYHNWRHGFNVGQTMFTLLMTGRLKKYYTDLEAFAMLAAAFCHDIDHRGTNNLYQMKSTSPLARLHGTSILERHHLEYSKTLLQDESLNIFQNLNKRQFETVIHLFEVAIIATDLALYFKKRTMFQKIVDTCEQMQSEEETIKYVTSDPTKKEVIMAMMMTACDLSAITKPWEVQSQPMMDRSKKDELPKLQVGFIDFVCTFVYKEFSRFHGEITPMLNGLQNNRVEWKSLAEEYEAKVKVTEEEAGKQEEEASDGKAATDLGGSAEDKKSKTCLML

SEQ ID NO: 3504 - protein, 105 aa, Mus musculus
LYENGINGILADEMGLGKTLQTISLLGYMKHYRNIPGPHMVLVPKSTLHNWMSEFKKWVPTLRSVCLIGDKEQRAAFVRDVLLPGEWDVCVTSYEMLIKEKSVFK

SEQ ID NO: 3505 - protein, 99 aa, Mus musculus
INGILADEMGLGKTLQTISLLGYMKHYRNIPGPHMVLVPKSTLHNWMSEFKKWVPTLRSVCLIGDKEQRAAFVRDVLLPGEWDVCVTSYEMLIKEKSVF

SEQ ID NO: 3506 - protein, 737 aa, Mus musculus
MWLLLHVILLTEVKDFALADSSMVAPLCPKGYFPCGNLTKCLPRAFHCDGVDDCGNGADEDNCGDTSGWTTIFGTVHGNVNKVTLTQECFLSQYPQHCYCRENELECVKADLKAVPKVSSNVTLLSLKKNKIHRLPVKVFSRYTELRKIYLQHNCITHISRRAFLGLHNLQILYLSHNCITSLRPGIFKDLHQLAWLILDDNPITRISQKSFMGLNSLFFLSMVGNRLEALPETLCAQMPQLNWVDLANNGIKYITNSTFLTCDSLTVLFLPRNQIGFVPEKTFSSLKNLGELDLSSNMITKLPVHLFSDLHLLQKLNLSSNPLLYVHKNQFGSLKQLQSLDLERIEIPNISTGMFQPMKNLSHIYLKTFRYCSYVPHVRICMPSTDGISSSEDLLANGILRVSVWVIAFITCVGNFLVIAVRSLIKAENTTHAMSIKILCCADCLMGVYLFSVGVFDIKYRGQYQKYALLWMESVPCRLLGFLATLSTEVSVLLLTFLTLEKFLVIVFPFSNLRLGKRQTAVALASIWVVGFLIAAVPFTREDYFGNFYGKNGVCFPLHYDQAEDFGSRGYSLGIFLGVNLLAFLVIVISYVTMFCSIHKTALQTAEVRSHIGKEVAVANRFFFIVFSDAICWIPVFVVKILSLLQVEIPGTITSWIVVFFLPVNSALNPILYTLTTSFFKDKLKQLLHKHRRKPIFKVKKKSLSASIVWTDESSLKLGVLSKIALGDSIMKPVSP

SEQ ID NO: 3507 - protein, 1659 aa, Oncorhynchus mykiss
MRAVVLALTLALVASQSVNFAPDFAASKTYVYKYEALLLGGLPEEGLARAGVKVISKVLISAVAENTYLLKLVNPEIFEYSGVWPKDPFVPAAKLTSALAAQFSIPIKFEYAKGVVGKVLAPTAVSETVLNVHRGILNILQLNIKKTQNVYELQEAGAQGVCKTHYVIREDAKAERIHLTKSKDLNNCQQRIMKDFGLAYTEKCVECRQRGEALMGAATYNYLMKPADNGALILEATVTELHQFTPFNEMSGAAQMEAKQMLTFVEIKKDPIIVPDNNYVHRGSIRYEFATEILQMPIQLLKISNARAQAVKILNHLVTYNTAPVHEDAPLKFLQFIQLLRMASSETINAIWAEFKAKPAYRHWILDAVPSIGSSVAVRFIKEKFLAGDITIFEAAQALVAAVHMVAADLETVKLVESLAFNHKIQTHPVLRELTMLGYGTMVSKYCVEHPNCPAELVKPIHELAVQAVANSKFEELSMVLKALGNAGHPASIKPITKLLPVFGTAAAALPLRVQADAVLALRNIAKREPRMVQEVAVQLFMDKALHPELRMLACIVLFETKPPMGLVITLASILKTEKNMQVASFTYSHMMSLTRSTAPDFASVAAACNVAVKMLSNKFRRLSCHFSQAIHLDAYSNPLRIGAAASAFYINDAATLFPRTVVAKARTYFAGAAADVLEVGVRTEGIQEALLKLPPAPENADRITKMRRVIKALSDWRSLATSKPLASIYVKFFGQEIAFANIDKSIIDQALQLANSPSAHALGRNALKALLAGATFQYVKPLLAAEVRRIFPTAVGLPMELSYYTAAVAKAYVNVRATLTPALPETFHAAQLLKTNIELHAEVRPSIVMHTFAVMGVNTAFIQAAIMARAKVRTIVPAKFAAQLDIANGNFKFEAFPVSPPEHIAAAHIETFAVARNVEDVPAERITPLIPAQGVARSTQQSRDKLTSMIADSAASFAGSLSRSSEILYSDLPSNFKPIIKAIVVHLEETICVERLGVKACFEFTSESAAFIRNTLFYNMIGKHSVLISVKPSASEPAIERLEFEVQVGPKAAEKIIKVITMNEEEEAPEGKTVLLKLKKILLPDLKNGTRASSSSSSSSSSSSRSSSSRSRSRKSESSSSSSSSSSRISKRDGPDQPYNPNDRKFKKNHKDSQSTSNVISRSKSSASSFHAIYKQDKFLGNKLAPMVIILFRLVRADHKIEGYQVTAYLNKATSRLQIIMAALDENDNWKLCADGVLLSKHKVTAKIAWGAECKDYNTFITAETGLVGPSPAVRLRLSWDKLPKVPKAVWRYVRIVSEFIPGYIPYYLADLVPMQKDKNNEKQIQFTVVATSERTLDVILKTPKMTLYKLGVNLPCSLPFESMTDLSPFDDNIVNKIHYLFSEVNAVKCSMVRDTLTTFNNKKYKINMPLSCYQVLAQDCTTELKFMVLLKKDHASEQNHINVKISDIDVDLYTEDHGVIVKVNEMEISNDNLPYKDPSGSIKIDRKGKGVSLYAPSHGLQEVYFDKYSWKIKVVDWMKGQTCGLCGKADGENRQEYRTPSGRLTKSSVSFAHSWVLPSDSCRDASECLMKLESVKLEKQVIVDDRESKCYSVEPVLRCLPGCLPVRTTPITIGFHCLPVDSNLNRSEGLSSIYEKSVDLMEKAEAHVACRCSEQCM

SEQ ID NO: 3508 - protein, 988 aa, Mus musculus
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTETVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDEEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRIQGSAQSDPERSQLQVESRPLQNGASITGTSVVTVSQITPIQTSLAYVKTSESLKQNNRDAMELKPNGGAEPKCLKVNSPIRMKNGNGKGWLRLKNNMGAQEEKKEDWNNVTKAESMGLLSEDPKGSDSENSVTKNPLRKTDSCDSGITKSDLRLDKAGEARSPLEHSPSQADVKHSFYPIPEQALQTTLQEVKHELKEDIQLLSCRMTALEKQVAEILKLLSEKSVPQTSSPKPQIPLQVPPQIPCQDIFSVSRPESPESDKDEINF

SEQ ID NO: 3509 - protein, 139 aa, Mus musculus
MKLVSIFLLVTIGICGYSATALLINRLPVVDKLPVPLDDIIPSFDPLKMLLKTLGISVEHLVTGLKKCVDELGPEASEAVKKLLVIIICSYFPGRSLCYVNNLPSFVSVLFLPMICAYPRDSKKQTFAFIERVFEQSKL

SEQ ID NO: 3510 - protein, 58 aa, Mus musculus
FPVSKDPSTKGLDPHLSHQMTKRKRMVLVKERKAAQTLSAILLAFIITWTPYNIMVLV

SEQ ID NO: 3511 - protein, 60 aa, Mus musculus
LSHQMTKRKRMVLVKERKAAQTLSAILLAFIITWTPYNIMVLVSTFCDKCVPVTLWHLGY

SEQ ID NO: 3512 - protein, 427 aa, Bos taurus
MLRKLWRRKLFSFPTKYYFLFLAFSVVTFTVLRIHQKTEFVNFGHLELFEENPSSNINCTKILQGDVDEIQKVKLESLTVKFKKRARWTNYDYINMTGDCASFIKKRKYITEPLSKEEAGFPIAYSIVVHHKIEMLDRLLRAIYMPQNFYCIHVDAKSEKSFLAAAVGIASCFSNVFVASQLESVVYASWSRVQADLNCMQDLYQMNAGWKYLINLCGMDFPIKTNLEIVRKLKLLMGENNLETEKMPSHKKERWKKHYEVVNGKLTNMGTDKIHPPLETPLFSGSAHFVVSREYVEYVLQNQNIQKFMEWAKDTYSPDEYLWATIQRIPEVPGSLSLSYKYDTSDMQAIARFVKWQYFEGDVSKGAPYPPCSVHVRSVCVFGAGDLNWLLHVHHLFANKFDTDIDLFAIQCLDEHLRHKALETLKP

SEQ ID NO: 3513 - protein, 43 aa, Gallus gallus
HINVLKKFMCVLVVILIALTVCLWKETRGSYYVPLKNDGTQVH

SEQ ID NO: 3514 - protein, 48 aa, Gallus gallus
HINVLKKFMCVLVVILIALTVCLWKETRGSYYVPLKNDGTQVHRALDK

SEQ ID NO: 3515 - protein, 348 aa, Mus musculus
MKGLYFQQSSTNEEVTFVFQEKENVPVTEDNFVRVQVKACALSHINTKLLAEMKMEKDFFPVGREVSGIVLEVGRKVTFFQPDDEVVGILPLDSEDPGLCEVIRVHEHYLVHKPEKVSWTEAAGVIRDGVRACTALYYLSQLSPGKSVLIMDGASAFGTIAIQLAHHRGAKVISTAHSLEDKQHLERLRPSIARVIDVSNGKVHVAESCLEETGGLGVDIVIDAGVRLYSKDDEPAVKLHLPHKHDIITLLGVGGHWVTTEENLQLDPPDSHCLFLKGATVAFLNDEVWNLSNAQQGKYLCILKDVMEKLSAGVFRPLLDEPIPLYEAKVSMEVVQKNQERKKQVVQF

SEQ ID NO: 3516 - protein, 146 aa, Mus musculus
KGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNMLFSGSLKAIKVWDIVGTELKLKKELTGLNHWVRALVAAQSYLY

SEQ ID NO: 3517 - protein, 110 aa, Mus musculus
YKCQKTLEGHDGIVLALCIQGCKLYSGSADCTIIVWDIQNLQKVNTIRAHDNPVCTLVSSHNMLFSGSLKAIKVWDIVGTELKLKKELTGLNHWVRALVAAQSYLYSGSY

SEQ ID NO: 3518 - protein, 689 aa, Mus musculus
MNSKARSLLWTIRRFSTLLPRSRALRIDPLGTCRPEVIHSKWNPRNHRLNVFDEGLQPSVRYLFQDIFISKSVDGCIQTKGISHSAVFKPDRLLCPRRLSFDAKHSFVSDGTSDHDLKKINFHHTSSEDVFTKKVRPTPVNYKKLAQECNSLSDVLDTFSKAPTFPGSNYFLAMWIIAKRISEDKRRFERQLMFSHPAFNQLCEQMMREAKIMHYDHLLFSLNAIVKLGIPQNTLMVQTLLRTIQERINECDERCLSILSTALVSMEPCMNVNALRAGLRILVDQQVWNIKHVFTLQTVMKCIGKDAPSALKKKLEMKALKELGRFSILNSQHMFEVLAAMDLRSVVLLNECSKVVIDNVHGCPFKVLISILQSCRDLRYQNEDLFKSIAEYVATTFDIWKLKQVIFFLLLFETLGFRPPGLMDKLMEKVVQEPGSLNVKNIVSILHVYSSLNHVHKIHNREFLEALASALTGCLHHISSESLLNAVHSFCMMNYFPLAPINQLIKENIINELLTSGDTEKNIHKLHVLNTCLKLDESTYKSVHIPLPQLPLSASQPNEKLAEVLSRLLEGEGRFSRNVPLPHNYHIDFEIRMDTNRTQVFSFSDVDASSATNMQRVAVLCVPKSVYCLNSCHPRGLMAMKIRHLNVMGFHVILIHNWELKKLKMEDAVTFVRKKIYSDEVLPTADTTV

SEQ ID NO: 3519 - protein, 463 aa, Schizosaccharomyces pombe
MLYTHANIITVNPTRDILIDGAILVKDGSNTIDDIGKTDRLVSIYPNEKHKSLEGHIVMPGLISLHVHLAQSLLRSAADDLPLISWLCDTVWKMQGNFTQEDGYVASQLTIAEMLKSGTTTFVEALFAQRYGIEGAVKAVIESGIRGCIGKVVMDQPRYATQTGVSMHEGLIENSNSLNQAVESHSKFHGKGNGRVEIWFGARTPGGVSEELYRKMVKIARANNIGITMHCAEVKADREFFASKEHTPMTYCKDLGLLGPKTVLAHMVHLDTQDLEILEKHGNGTSVAHCPVSNSKLGSGIAPLKEMLEKSIIVGIGCDGCPCNNTMDLLQEMKMASLLPKALHGDPSIVPAEKIVEMATINGAKALGRDDLGSLEVGKKADFISLDLSNKLYAQPLRDLVSAVVYIATGADVATVVIDGKLIVEDHVLLTIDEPKLIDKAKKHGKKLQERAKVDVKGRWKEI

SEQ ID NO: 3520 - protein, 161 aa, Rattus norvegicus
TKAFGEEFKKTYGHHKTFLDHLKGCCSCSSQKAKKIALSLFPIASWLPAYKIKEWLLSDIVSGISTGLVAVLQGLAFALLVNIPPAYGLYAAFFPVITYFFLGTSRHISVGPFPVLSMMVGVVVTRVASGSDTSPALSSSSAENDSMIEEKVMVAASVTVL

SEQ ID NO: 3521 - protein, 117 aa, Rattus norvegicus
KKTYGHHKTFLDHLKGCCSCSSQKAKKIALSLFPIASWLPAYKIKEWLLSDIVSGISTGLVAVLQGLAFALLVNIPPAYGLYAAFFPVITYFFLGTSRHISVGPFPVLSMMVGVVVT

SEQ ID NO: 3522 - protein, 188 aa, Mus musculus
KISGLVQGISVAASVFTLVAIAVDRFRCVVYPFKPKLTVKTAFVTIVIIWGLAIAIMTPSAIMLHVQEEKYYRVRLSSHNKTSTVYWCREDWPRHEMRRIYTTVLFATIYLAPLSLIVIMYARIGASLFKTAAHCTGKQRPVQWHVSKKKQKVIKMLLTVALLFILSWLPLWTLMMLSDYTDLSPNKL

SEQ ID NO: 3523 - protein, 59 aa, Mus musculus
VLFATIYLAPLSLIVIMYARIGASLFKTAAHCTGKQRPVQWHVSKKKQKVIKMLLTVAL

SEQ ID NO: 3524 - protein, 423 aa, Mus musculus
MASPRVFPLSCVVQQYAWGKVGSKSEVACLLASSDPLAQISEDKPYAELWMGTHPRGDAKILDNRISQKTLGQWIAENPDCLGSKVKNTFNGKLPFLFKVLSVDTALSIQAHPNKELAEKLHLQAPEHYPDANHKPEMAIALTSFQGLCGFRPVEEIVTFMKKVPEFQLLIGDDATAQLKESVGGDTEAMASALRNCFSHLMKSEKKVVVEQLNLLVKRISQQVFDGNNMEDIYGKLLLQLHQQHPGDIGCFAIYFLNLLTLKPGEAMFLDANVPHAYLKGDCVECMACSDNTVRAGLTPKFIDVPTLCEMLNYTPSPSNNRLFAPAQSQDDPYLSIYDPPVPDFTVMKMEVPSSVTEYKVSTLDSASILLMVQGTVTAIIPSAHAEIPLYRGGVLFIAANESVLLKITVPKDLLIFRACCLL

SEQ ID NO: 3525 - protein, 200 aa, Mus musculus
LDEDLHVKHPRLLTFASQLKAGKGLTIVGSVIVGNFLENYGDALAAEQTIKHLMEAEKVKGFCQLVVAAKLKEGISHLIQSCGLGGMKHNTVVMGWPNGWRQSEDARAWKTFIGTVRVTTAAHLALLVAKNVSFFPSNVEQFSEGNIDVWWIVHDGGMLMLLPFLLKQHKVWRKCSIRIFTVAQLEDNSIQMKKDLATFL

SEQ ID NO: 3526 - protein, 189 aa, Mus musculus
LLTFASQLKAGKGLTIVGSVIVGNFLENYGDALAAEQTIKHLMEAEKVKGFCQLVVAAKLKEGISHLIQSCGLGGMKHNTVVMGWPNGWRQSEDARAWKTFIGTVRVTTAAHLALLVAKNVSFFPSNVEQFSEGNIDVWWIVHDGGMLMLLPFLLKQHKVWRKCSIRIFTVAQLEDNSIQMKKDLATFL

SEQ ID NO: 3527 - protein, 200 aa, Mus musculus; identical to SEQ ID NO: 3525

SEQ ID NO: 3528 - protein, 189 aa, Mus musculus; identical to SEQ ID NO: 3526

SEQ ID NO: 3529 - protein, 378 aa, Rattus norvegicus
MDLIGLLKSQFLCHLVFCYVFIASGLIVNAIQLCTLVIWPINKQLFRKINARLCYCVSSQLVMLLEWWSGTECTIYTDPKASPHYGKENAIVVLNHKFEIDFLCGWSLAERLGILGNSKVLAKKELAYVPIIGWMWYFVEMIFCTRKWEQDRQTVAKSLLHLRDYPEKYLFLIHCEGTRFTEKKHQISMQVAQAKGLPSLKHHLLPRTKGFAITVKCLRDVVPAVYDCTLNFRNNENPTLLGVLNGKKYHADCYVRRIPMEDIPEDEDKCSAWLHKLYQEKDAFQEEYYRTGVFPETPWVPPRRPWSLVNWLFWASLLLYPFFQFLVSMVSSGSSVTLASLVLIFCMASMGVRWMIGVTEIDKGSAYGNIDNKRKQTD

SEQ ID NO: 3530 - protein, 950 aa, Rattus norvegicus
MAASTGYVRLWAAARCWVLRRPLLAVTGGRVPSASGSWLRRGCRVCDTSTPWGGRVPMGGGQWRGLWDAGSRGGSDETSEGGVEDGATASSGEGPVVTALAPMTVPDVFPHLPLIAISRNPVFPRFIKIVEVKNKKLVELLRRKVRLAQPYVGVFLKRDDNNESDVVESLDEIYHTGTFAQIHEMQDLGDKLRMIVTGHRRIHISRQLEVEPEGLEPEAENKQKSRRKLKRGKKEVGDELGAKPQLEMVTEATSDTSKEVLMVEVENVAHEDFQVTEEVKALTAEIVKTIRDIIALNPLYRESVLQMMQAGQRVVDNPIYLSDMGAALTGAESHELQDVLEETNILKRLYKALSLLKKEFELSKLQQRLGREVEEKIKQTHRKYLLQEQLKIIKKELGLEKDDKDAIEEKFRERLKELVVPKHVMDVVDEELSKLALLDNHSSEFNVTRNYLDWLTSIPWGRQSDENLDLARAQSVLEEDHYGMEDVKKRVLEFIAVSQLRGSTQGKILCFHGPPGVGKTSIARSIARALGREYFRFSVGGMTDVAEIKGHRRTYVGAMPGKIIQCLKKTKTENPLVLIDEVDKIGRGYQGDPSSALLELLDPEQNANFLDHYLDVPVDLSKVLFICTANVTDTIPEPLRDRMEMINVSGYVAQEKLAIAERYLVPQARTLCGLDESKAQLSATVLTLLIKQYCRESGVRNLQKQVEKVLRKAAYKIVSGEAQTVHVTPENLQDFVGKPVFTVERMYDVTPPGVVMGLAWTAMGGSTLFVETSLRRPQPSGSKEDKDGSLEVTGQLGDVMKESARIAYTFARAFLMEQDPENDFLVTSHIHLHVPEGATPKDGPSAGCTIVTALLSLALGQPVLQNLAMTGEVSLTGKVLPVGGIKEKTIAAKRAGVTCIILPAENRKDFSDLAPFITEGLEVHFVEHYRDIFRIAFPLREHQEALAVER

SEQ ID NO: 3531 - protein, 339 aa, Rattus norvegicus
MVGAENMTASFSNNRCHDTIDEFRNQVYSTMYSMISVVGFFGNSFVLYVLIKTYHEKSAFQVYMINLAIADLLCVCTLPLRVVYYVHKGKWFFGDFLCRLTTYALYVNLYCSIFFMTAMSFFRCVAIVFPVQNINLVTQKKARFVCVGIWIFVILTSSPFLLSKSYQDEKNNTKCFEPPQDKQTKKYVLVLHYVSLIFGFIIPFVTIIVCYTMIILTLLKNTMKKNLPSRRKAIGMIIVVTAAFLVSFMPYHIQRAIHLHFLHSETRSCDSVLRMQKSVVITLSLAASNCCFDPLLYFFSGGNFRRRLSTFRKHSLSSMTYIPKKKASLPEKGEEMCKE

SEQ ID NO: 3532 - protein, 272 aa, Staphylococcus aureus
MKTVSLLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 3533 - protein, 372 aa, Staphylococcus aureus
MKIGIPREIKNNENRVGLSPSGVHALVESGHTVLVETNAGSGSFFEDVDYKEAGAEIVAEQAKVWDVDMVIKVKEPLESEYTYFKEGLVLFTYLHLANEEKLTQALIDRKVISIAYETVQLPDRSSPLLSPMSEVAGRMSAQVGAEFLQKLNGGMGILLGGVPGVPKGKVTIIGGGQAGTNAAKIALGLGADVTILDVNPKRLQQLDDLFGGRVHTIMSNPLNIELYVKQSDLVIGAVLIPGAKAPRLVTEDMIKQMKNGSVIIDIAIDQGGIFETTDKITTHDDPTYIKHGVVHYAVANMPGAVPRTSTLALNNATLPYALMLANKGYREAFKSNQPLSLGLNTYKGHVTNKGVAEAFEMEYKSVEEALQL

SEQ ID NO: 3534 - protein, 312 aa, Caenorhabditis elegans
MVREDRSTWKANYFTKLVELFEEYPKCLLVGVDNVGSKQMQEIRQAMRGHAEILMGKNTMIRKALRGHLGKNPSLEKLLPHIVENVGFVFTKEDLGEIRSKLLENRKGAPAKAGAIAPCDVKLPPQNTGMGPEKTSFFQALQIPTKIARGTIEILNDVHLIKEGDKVGASESALLNMLGVTPFSYGLVVRQVYDDGTLYTPEVLDMTTEELRKRFLSGVRNVASVSLAVNYPTLASVAHSLANGLQNMLGVAAVTDVSFKEAETIKAFIADPSKFAAAAPAAAAAPAAAAPAAKKEEPKEESDDDMGFGLFD

SEQ ID NO: 3535 - protein, 71 aa, Caenorhabditis elegans
IIIANHQSALDVLGMSFAWPVDCVVMLKSSLKYLPGFNLCAYLCDSVYINRFSKEKALKTVDTTLHEIVTK

SEQ ID NO: 3536 - protein, 89 aa, Caenorhabditis elegans
IIANHQSALDVLGMSFAWPVDCVVMLKSSLKYLPGFNLCAYLCDSVYINRFSKEKALKTVDTTLHEIVTKKRKVWIYPEGTRNAEPELL

SEQ ID NO: 3537 - protein, 464 aa, Lactobacillus brevis
MKEGIDMRESVAEEPKHKFFQSTEGENKSLDEVNGSVKVPKNAGFWRTLFAYTGPGILIAVGYMDPGNWITSIAGGAQFKYSLLSVILISSLIAMLLQSMAARLGIVTGKDLAQLTRERTSKTMGIILWLITESAIMATDVAEIIGSGIAIKLLFNIPLVVGILITTADVLILLLLMKLGFRKIEAIVATLVAVILLVFTYEVFLAGPQLDQMFAGYMPTKDIVTNKSMLYLALGIVGATVMPHDLYLGSSISQTRAVDRHDRQDVAKAIKFTTIDSNLQLTIAFIVNSLLLILGAALFFGTNSTVGRFVDLFNSLNNSHIVGAIASPMLSMLFAVALLSSGQSSTITGTLSGQIIMEGFIHLRMPLWAQRLLTRLLSVTPVLIFAIYYHGNEAKIENLLTLSQVFLSVALPFAIVPLVKFTSSKELMGEFVNKAWVKYSAWVATVVLVSLNIYLILQTVGVIG

SEQ ID NO: 3538 - protein, 447 aa, Arabidopsis thaliana
MGWIPCPCWGTNDDENAGEVADRDPVLLVSGIGGSILHSKKKNSKSEIRVWVRIFLANLAFKQSLWSLYNPKTGYTEPLDDNIEVLVPDDDHGLYAIDILDPSWFVKLCHLTEVYHFHDMIEMLVGCGYKKGTTLFGYGYDFRQSNRIDLLILGLKKKLETAYKRSGGRKVTIISHSMGGLMVSCFMYLHPEAFSKYVNKWITIATPFQGAPGCINDSILTGVQFVEGLESFFFVSRWTMHQLLVECPSIYEMMANPDFKWKKQPEIRVWRKKSENDVDTSVELESFGLIESIDLFNDALKNNELSYGGNKIALPFNFAILDWAAKTREILNKAQLPDGVSFYNIYGVSLNTPFDVCYGTETSPIDDLSEICQTMPEYTYVDGDGTVPAESAAAAQFKAVASVGVSGSHRGLLRDERVFELIQQWLGVEPKKAKRKHLRTHKVVDSG

SEQ ID NO: 3539 - protein, 357 aa, Ocimum basilicum
MALQKVDISLSTEQLLQAQVHVWNHMYAFANSMSLKCAIQLGIPDILHKHGRPMTLSQLLQSIPINKEKTQCFQRLMRALVNSNFFIEENNSNNQEVCYWLTPASCLLLKEAPLTVTPLVQVVLDPTFTNPWHHMSEWFTHEKHATQFEAANGCTFWEKLANEPSKGRFFDEAMSCDSRLIAHVFTKDYKHVIEGIRTLVDVGGGNGTMAKAIVEAMPTIKCTVIDLPHVVAGLESTDNLNYIGGDMFQSIPSADAILLKSIIHDWDDVEGLKILKKCKDAVVMGGKVIIIDVVVGVNHDIDEVLEDQLHFDMAMMCYFNAKERTMSEWEKLIYDAGFKSYKLTPAFGVRSLIEAYP

SEQ ID NO: 3540 - protein, 356 aa, Ocimum basilicum
MALQNMDISLSTEQLLQAQAHVWNHMYAFANSMSLKCAIQLGIPDILHKHDHPMTLSQLLKAIPINKEKSQSFQRLMRALVNSNFFIEENSNNQEVCYWLTPASRLLLKGAPLTVAPLVQVVLDPTFTNPWHYMSEWFKHENHATQFEAANGCTFWEKLANKPSMGRFFDEAMSCDSRLVAHVLTKDYKHVIDGIRTLVDVGGGNGTMAKAIVEAVPTMKCTVLDLPHVVAGLESTDKLSYIGGDMFQSIPSADAILLKFIIHDWDDEEGLKILKRCKDAVGIGGKVIIIDVVVGVNHDVDEVLEDQLHFDMAMMSYFNAKERTMNEWEKLISAAGFTSYKLTPAFGVRSLIEAYP

SEQ ID NO: 3541 - protein, 45 aa, Arabidopsis thaliana
ESLLKRLMSQQHCWLFNTPVDVVKLNIPDYFTIIKHPMDLGTVKS

SEQ ID NO: 3542 - protein, 42 aa, Arabidopsis thaliana
LLKRLMSQQHCWLFNTPVDVVKLNIPDYFTIIKHPMDLGTVK

SEQ ID NO: 3543 - protein, 493 aa, Arabidopsis thaliana
MSTEMEVVSVLKYLDNKSILVVGAAGFLANIFVEKILRVAPNVKKLYLLLRASKGKSATQRFNDEILKKDLFKVLKEKYGPNLNQLTSEKITIVDGDICLEDLGLQDFDLAHEMIHQVDAIVNLAATTKFDERYDVALGINTLGALNVLNFAKRCAKVKILVHVSTAYVCGEKSGLIMETPYRMGETLNGTTGLDINYEKKLVQEKLDQLRVIGAAPETITETMKDLGLRRAKMYGWPNTYVFTKAMGEMMVGTKRENLSLVLLRPSIITSTFKEPFPGWTEGIRTIDSLAVGYGKGKLTCFLCDLDAVSDVMPADMVVNSILVSMAAQAGKQEEIIYHVGSSLRNPMKNSKFPELAYRYFSIKPWTNKEGKVVKVGAIEILSSMRSFHRYMTIRYLIALKGLELVNIILCKLFEKEFQYFNKKINFIFRLVDLYQPYLFFYGIFDDSNTEKLRKMVSKTGVENEMFYFDPKVLDWDDYFLNTHVIGLLKYVF

SEQ ID NO: 3544 - protein, 361 aa, Oryza sativa
MKALILVGGFGTRLRPLTLSFPKPLVDFANKPMILHQIEALKEVGVTEVVLAINYRPEVMLNFLKDFEDKLGITITCSQETEPLGTAGPLALARDKLVDGSGEPFFVLNSDVISEYPFAELIKFHKSHGGEATIMVTKVDEPSKYGVVVMEEVTGMVEKFVEKPKIFVGNKINAGIYLLNPSVLDRIELKPTSIEKEVFPRIASDAKLFALVLPGFWMDVGQPRDYITGLRLYLDSLRKRSTNRLATGAHIVGNVLVHESAKIGEGCLIGPDVAIGPGCVVEDGVRLSRCTVMRGVHIKKHACISNSIIGWHSTVGQWARIENMTILGEDVHVGDEVYTNGGVVLPHKEIKSSILKPEIVM

SEQ ID NO: 3545 - protein, 390 aa, Caenorhabditis elegans
MADTRELPVFAYIDDVKQLQELRQYLNKHDSVKLDPNGPSETAQNMIEICSTLNVLPSWSQDVDLVLNSISSLIVVVPGEKCEPVVDSFIKNVAPQFYKGTGWASHAGIAVRVLSNLYKGYSNFHTVQEKIFKALVDMCAEARLIGELECNLETLQDRFNTWKTPVEGQREILRAVHRALLVDQRVDQAAKVMTALLGTYTEKDAAAARDDAMECVRTAVVDPKSFSFDHLERLSAVKALKTSDPLMFTALELFISGTLKDYKEFVAKNPKFVTEHLKVDETILLKKIRLLTLMSLAEEKNEISLDELAKQLDILADETLEEFVIDAIQVNAISGKINEMARTLIVSSYQHRRFGTEQWVLLEKRLKVLIANLKQTHNNVHEVNQRIEAL

SEQ ID NO: 3546 - protein, 113 aa, Arabidopsis thaliana
QVHQNMDAPLSHYFIFTGHNSYLTGNQLSSNCSELPIADALRRGVRVVELDLWPRGTDDVCVKHGRTLTKEVKLGKCLESIKANAFAISKYPVIITLEDHLTPKLQFKVAKMI

SEQ ID NO: 3547 - protein, 76 aa, Arabidopsis thaliana
VVELDLWPRGTDDVCVKHGRTLTKEVKLGKCLESIKANAFAISKYPVIITLEDHLTPKLQFKVAKMITQTFGDMLY

SEQ ID NO: 3548 - protein, 113 aa, Arabidopsis thaliana
LVHQNMDAPLSHYFIFTGHNSYLTGNQLSSNCSELPIADALRRGVRVVELDLWPRGTDDVCVKHGRTLTKEVKLGKCLESIKANAFAISKYPVIITLEDHLTPKLQFKVAKMI

SEQ ID NO: 3549 - protein, 76 aa, Arabidopsis thaliana; identical to SEQ ID NO: 3547

SEQ ID NO: 3550 - protein, 583 aa, Arabidopsis thaliana
MAVTLVTSFASSSSRFHFRSFSSSPSSLSSCFVRFQFPSRLRLAFAVTPLYSSSRAMAHTISHATLGLTQANSVDHPKISFSGKEIDVTEWKGDILAVGVTEKDMAKDVNSKFENPILKKLDAHLGGLLADVSSEEDFSGKPGQSTVLRLPGLGSKRVGLIGLGKSASTPSAFQSLGEAVAAAAKASQASSVAVVLASSESVSNESKLCSASAIASGTVLGLFEDSRYKSESKKPSLKSVDIIGFGSGPELEKKLKYAEHVSYGVIFGKELVNSPANVLTPAVLAEEALNLASMYSDVMTANILNEEQCKELKMGSYLAVAAASANPPHFIHLIYKPSSGPVKTKLALVGKGLTFDSGGYNIKTGPGCLIELMKFDMGGSAAVLGAAKAIGQIKPPGVEVHFIVAACENMISGTGMRPGDVLTASNGKTIEVNNTDAEGRLTLADALVYACNQGVDKVVDLATLTGACIIALGTSMAGIYTPSDKLAKEVIAASERSGEKLWRMPMEESYWEMMKSGVADMVNTGGRAGGSITAALFLKQFVSEDVEWMHIDMAGPVWNEKKKAATGFGVATLVEWVQNHSSS

SEQ ID NO: 3551 - protein, 545 aa, Schistosoma mansoni
MLTLGGERTSGESVRKQNVLAACSFANFVKTSLGPVGLDKMLVDDVGDVTITNDGATILKLLDVEHPAAKILVQLAQLQDEEVGDGTTSVVILAAALLKNADELISRFVHPTTVINGYRLACREACKYIQEHMAYDVNKLGKAGLINVARTAMSSKLINLDADMFSQMAVDALMAVEVSGGPKGPVYPIKAVNILKAHGRSMSESMLIDGYALNCTAASQQMPRIIKKAKIAFLDFSLQKVKMKLGVQVVVKDPAQLEAIRQREADITKERIQKILNAGANVILTTGGIDDLCMKYFVEVNAMAVRRCKKVDLKNMAKATGGQLIVSLADMEGDEVFDPTKLGNAEEVSQERICDDELIILRGPKVHPSASIILRGANDFYVDEMERSLHDALLVVKRVLESKRIVPGAGACETAVSIYLENYALTLSSREQLAIAEFARAMLSIPKQLAVNAGVDSTELVARLRSCHNSSQSKPDQAHNKWWGLDLNNQYVADCKEIGVFEPLVSKIKSLKFATEAAITILRIDDLIKLKEEKQPDHDGDECGY

SEQ ID NO: 3552 - protein, 199 aa, Arabidopsis thaliana
EVVKKSPLPIPTDAIFYAGTGNLLCRSEDKVVIFDLQQRLVLGELQTPFVRYVVWSSDMESVALLSKHTIIIASKKLVLQCTLHETIRVKSGAWDDNGVFIYTTLNHIKYCLPNGDSGIIRTLDVPIYITKVSGNTIFCLDRDGKNKAITINATEYIFKLSLLRKRYDHVMSMIKNSQLCGQAMIAYLQQKGFPEVALH

SEQ ID NO: 3553 - protein, 35 aa, Arabidopsis thaliana
FVRYVVWSSDMESVALLSKHTIIIASKKLVLQCTL

SEQ ID NO: 3554 - protein, 149 aa, Arabidopsis thaliana
LATQTEKTIQAIGLHANIQAHACIGGNSVGEDIRKLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFD

SEQ ID NO: 3555 - protein, 113 aa, Arabidopsis thaliana
KLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWK

SEQ ID NO: 3556 - protein, 140 aa, Arabidopsis thaliana
TLKVLKHPNIVRLHEVLASKTKIYMVLECVTGGDLFDRIVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVI

SEQ ID NO: 3557 - protein, 127 aa, Arabidopsis thaliana
EVLASKTKIYMVLECVTGGDLFDRIVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVIL

SEQ ID NO: 3558 - protein, 423 aa, Oryza sativa
MDKLSGSARLIIVSDLDHTMVDHHDEENLSLLRFGALWESVYCQDSLLVFSTGRSPTLYKELRKEKPMLTPDITIMSVGTEITYGEAMVPDDGWEEYLNNKWDRNVVVEETAKFSELKLQPETEQRPHKVSFFVDKKSAQEVIKSLSGNMEKCGLDVKIIYSGGQDLDILPQGAGKGQALAYLLKKLSSCGKPPNNTLVCGDSGNDAELFSIPGVHGVMVSNAQEELLQWYAENAKGNPKIIHATERCAAGIIEAIGHFKLGPSVSPRDVGFPYVKEDHIKPTDAVVKFYVLYEKWRRAEVPKSDSVVQYFKNITHANGVIIQPSGLECSLHASVDALSSCYGEKQGKKYRTWVDRLFVSQSGSDSWLVRFDLWEAEGDARLCCLTSLALNVKPETPAGFLITHVHKTWLKGYSSADEQSSKL

SEQ ID NO: 3559 - protein, 340 aa, Arabidopsis thaliana
MADRSKGFMRAEFVTYAYILLYIALSSGQIFFNKWVLSSKEINFPYPLGLTLLHMIFSSVLCFLLTKVLKIVKVEEGMTLEIYVTSVIPIGAMFAMTLWLGNTAYLYISVAFAQMLKAIMPVAVFILGVAAGLEMMSCRMLLIMSIISFGVLVASYGELNINWIGVVYQMGGVVGEALRLIFMELLVKRKGIKLNPISLMYYVSPCSAICLFVPWIFLEKSKIDGNGPWNFHFVVLTLNSLCTFALNLSVFLVISHTSALTIRVAGVVKDWVVVLVSALLFADTKLTIINLFGYAIAIAGVAAYNNHKLKKEASKVVTTETPGDAESIPLVSQGNTNTER

SEQ ID NO: 3560 - protein, 504 aa, Nicotiana tabacum
MQFFSLVSIFLFLSFLFLLRKWKNSNSQSKKLPPGPWKIPILGSMLHMIGGEPHHVLRDLAKKYGPLMHLQLGEISAVVVTSRDMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDIFAKKIREVIGLAEGFDVVDIFPTYKFLHVLSGMKRKLLNAHLKVDAIVEDVINEHKKNLAAGKSNGALGGEDLIDVLLRLMNDTSLQFPITNDNIKAVIVDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPTGIMPRDLDLTELSGITIARKGGLYLNATPYQPSRE

SEQ ID NO: 3561 - protein, 133 aa, Nicotiana tabacum
SAFGQVLKGQDIFAKKIREVIGLAEGFDVVDIFPTYKFLHVLSGMKRKLLNAHLKVDAIVEDVINEHKKNLAAGKSNGALGGEDLIDVLLRLMNDTSLQFPITNDNIKAVIVDMFAAGTETSSTTTVWAMAEM

SEQ ID NO: 3562 - protein, 104 aa, Nicotiana tabacum
FDVVDIFPTYKFLHVLSGMKRKLLNAHLKVDAIVEDVINEHKKNLAAGKSNGALGGEDLIDVLLRLMNDTSLQFPITNDNIKAVIVDMFAAGTETSSTTTVWAM

SEQ ID NO: 3563 - protein, 274 aa, Arabidopsis thaliana
MELHEISKLDNKKHPERIVESKMKKRMKPYSLTSLNNLDDGCLMHILSFLSPIPDRYNTALVCHRWRYLACHPRLWLRVDRFVKDLSQPGVFLNIESAVSAARPGDTILIVAGGNYRVSNIQIKKPLCLVGGGEIPDETTLVCARGSDSALELLSTCKLANLTVKAELGCCLLHRSGRLTIDGCVLQCETNPLDHLSCPIVSTAGDEDIENILSHVEVKETVTGKIKANSVTVLQTRIEGGAKAVSTRGDLVLQRVRVMYSKAYLYFWFDVDYE

SEQ ID NO: 3564 - protein, 491 aa, Arabidopsis thaliana
MDTSSSLLFFSFFFFIIIVIFNKINGLRSSPASKKKLNDHHVTSQSHGPKFPHGSLGWPVIGETIEFVSSAYSDRPESFMDKRRLMYGRVFKSHIFGTATIVSTDAEVNRAVLQSDSTAFVPFYPKTVRELMGKSSILLINGSLHRRFHGLVGSFLKSPLLKAQIVRDMHKFLSESMDLWSEDQPVLLQDVSKTVAFKVLAKALISVEKGEDLEELKREFENFISGLMSLPINFPGTQLHRSLQAKKNMVKQVERIIEGKIRKTKNKEEDDVIAKDVVDVLLKDSSEHLTHNLIANNMIDMMIPGHDSVPVLITLAVKFLSDSPAALNLLTEENMKLKSLKELTGEPLYWNDYLSLPFTQKVITETLRMGNVIIGVMRKAMKDVEIKGYVIPKGWCFLAYLRSVHLDKLYYESPYKFNPWRWQERDMNTSSFSPFGGGQRLCPGLDLARLETSVFLHHLVTRFRWIAEEDTIINFPTVHMKNKLPIWIKRI

SEQ ID NO: 3565 - protein, 370 aa, Hevea brasiliensis
MSSVNLGSWVHTSYVLNQATRSRSKSKSFSLPFNPLKSLAISFAYRKSERPISSVSAIITKEEETLQEEQNNPPPSFDFKSYMLQKGNSINQALEAAIPLQEPAKIHESMRYSLLAGGKRVRPALCLAACELVGGNDSMAMPAACAVEMIHTMSLIHDDLPCMDNDDLRRGKPTNHIVFGEDVAVLAGDALLAFAFEHIAVSTLNVSSARIVRAVGELAKAIGAEGLVAGQVVDINSEGSSEVDLEKLEFIHIHKTAKLLEGAVVLGAILGGGTDEEVEKLRKYARDIGLLFQVVDDILDVTKSSQELGKTAGKDLVADKVTYPKLLGIEKSREFAEKLNKEAQEQLAGFDPEKAAPLIALANYIAHRQN

SEQ ID NO: 3566 - protein, 69 aa, Arabidopsis thaliana
EFGLKNCFHESRVDVIIRISIGLLVQILCSYVTLPLYALVTQMGSKMKPTVFNERVATALKSWHHTAKK

SEQ ID NO: 3567 - protein, 53 aa, Arabidopsis thaliana
ISIGLLVQILCSYVTLPLYALVTQMGSKMKPTVFNERVATALKSWHHTAKKNI

SEQ ID NO: 3568 - protein, 156 aa, Arabidopsis thaliana
ILLQQLKGIFGLVHFTHKTDVVSVLHSILDNRAEWKWQSTLAGVCFLVFLQSTRYIKQRYPKLFWVSAMGPMVVVVVGCVVAYLVKGTAHGIATVGPLKKGLNPPSIQLLNFDSKYLGMVFKAGIVTGLIALAEGIAIGRSFAVMKNEQTDGNKEM

SEQ ID NO: 3569 - protein, 157 aa, Arabidopsis thaliana
LLQQLKGIFGLVHFTHKTDVVSVLHSILDNRAEWKWQSTLAGVCFLVFLQSTRYIKQRYPKLFWVSAMGPMVVVVVGCVVAYLVKGTAHGIATVGPLKKGLNPPSIQLLNFDSKYLGMVFKAGIVTGLIALAEGIAIGRSFAVMKNEQTDGNKEMIA

SEQ ID NO: 3570 - protein, 524 aa, Bos taurus
MGKPARKGCDWKRFLRNNWLLLSTVVAVVLGIVIGVLVREYSKLSNLEKFYFSFPGEILMRMLKLVILPLIVSSMITGVATLDSNVSGKIGLRAVVYYFCTTLIAVILGIVLVVSIKPGVTQKVNEIDRTGNTPEVSTVDAMLDLIRNMFPENLVQACFQQYKTTREEVELSEEPGTNSTEATVTAIMTTAISKNKTKEYKVVGMYSDGINVLGLIVFCLVLGIVIGRKWEKGQILVDFFNALSDATMKIVQIIMCYMPIGILFLIAGKIIEVEDWEIFRKLGLYMATVLSGLAIHSIVILPLIYFIIVRKNPFQFAMGMAQALLTALMISSSSATLPVTFRCAEEKNRVDKRITRFVLPVGATINMDGTALYEAVAAVFIAQLNDLDLSVGQIITISVTATAASIGAAGVPQPGLVTMVIVLSAVGLPAEDVTLIIAVDWLLDRFRTMVNVLGDAFGTGIVEKLSKKELEQMDVSSEVNIVNPFTLESTALDNEDSDTKKSYVNGGFAVDKSDTISFTQTSQF

SEQ ID NO: 3571 - protein, 147 aa, Hylobates syndactylus
MVHFTAEEKAAVTSLWNKMNVEEAGGEALGRLLVVYPWTQRFFDSFGNLSSPSAILGNPKVKAHGKKVLTSFGDAIKNMDNLKTTFAKLSELHCDKLHVDPENFKLLGNVMVIILATHFGKEFTPEVQAAWQKLVSAVAIALAHKYH

SEQ ID NO: 3572 - protein, 147 aa, Propithecus verreauxi
MVHFTAEEKSTILSVWGKVNVEEAGGEALGRLLVVYPWTQRFFDNFGNLSSPSAIMGNPKVKAHGKKVLTSFGEAVKNMDNLKGAFAKLSELHCDKLHVDPENFKLLGNAMVIILATHFGKEFTPDVQAAWQKLVSGVATALAHKYH

SEQ ID NO: 3573 - protein, 113 aa, Macaca fascicularis
KINDPLVTKVAFATALKNLYVSEVEINLEDVLGVLASAHILQFSGLFQRCVDVMITRLMPSTIKNFYEAGCKYKEEQLTTACEKWLEMNLVPLVGMQIHLRKIPQDLLHKVLK

SEQ ID NO: 3574 - protein, 115 aa, Macaca fascicularis
KINDPLVTKVAFATALKNLYVSEVEINLEDVLGVLASAHILQFSGLFQRCVDVMITRLMPSTIKNFYEAGCKYKEEQLTTACEKWLEMNLVPLVGMQIHLRKIPQDLLHKVLKSP

SEQ ID NO: 3575 - protein, 113 aa, Macaca fascicularis; identical to SEQ ID NO: 3573

SEQ ID NO: 3576 - protein, 115 aa, Macaca fascicularis; identical to SEQ ID NO: 3574

SEQ ID NO: 3577 - protein, 185 aa, Macaca fascicularis
KLAIVSLGVICTGGFLLLLLYWMPEWRVKATCVRAAIKDCDVVLLRTTDEFKMWFCAKIRVLSLETHPISSPKSMSNKLSNGHAVCLTENPTGENRHGISKYSQAESQQIRYFTHHSVKYFWNDTIHNFDFLKGLDEGVSCTSIYEKHSAGLTKGMHAYRKLLYGVNEIAVKVPSVFKLLIKEVL

SEQ ID NO: 3578 - protein, 31 aa, Macaca fascicularis
IKDCDVVLLRTTDEFKMWFCAKIRVLSLETH

SEQ ID NO: 3579 - protein, 186 aa, Macaca fascicularis
ATYVVAAGLQYGAEGGMLHTFFKMAWLGEIPALPVFGDGTNVIPTIHVLDLAGVIQNVIDHTPKPHYLVAVDESVHTLEDIVKCISKNTGPGKIQKIPRENAYLTKDLTQDCLDHLLVNLRMEALFVKENFNIRWVAQTGFVENINSILKEYKQSRGLMPVKICILGPPAVGKSSIAEELAKYYKL

SEQ ID NO: 3580 - protein, 138 aa, Macaca fascicularis
KMVLKFGRKTRKFATYVVAAGLQYGAEGGMLHTFFKMAWLGEIPALPVFGDGTNVIPTIHVLDLAGVIQNVIDHTPKPHYLVAVDESVHTLEDIVKCISKNTGPGKIQKIPRENAYLTKDLTQDCLDHLLVNLRMEAL

SEQ ID NO: 3581 - protein, 34 aa, Macaca fascicularis; identical to SEQ ID NO: 310

SEQ ID NO: 3582 - protein, 123 aa, Macaca fascicularis; identical to SEQ ID NO: 311

SEQ ID NO: 3583 - protein, 113 aa, Oryctolagus cuniculus
ASVCPDLAVIWVDAHTDINTPLTTTSGNLHGQPVSFLLKELKGKIPDVPGFSWVTPCISAKDIVYIGLRDVDPGEHYIVKTLGIKYFSMTEVDKLGIGKVMEETLCYLLGRKK

SEQ ID NO: 3584 - protein, 98 aa, Oryctolagus cuniculus
VDAHTDINTPLTTTSGNLHGQPVSFLLKELKGKIPDVPGFSWVTPCISAKDIVYIGLRDVDPGEHYIVKTLGIKYFSMTEVDKLGIGKVMEETLCYLL

SEQ ID NO: 3585 - protein, 66 aa, Macaca fascicularis
DTVEFNNHTLCYNNFQKHDPDLTVIRHHVLTWVKYIVGYLFPLLTMSICYLCLILKVKKRSILISS

SEQ ID NO: 3586 - protein, 37 aa, Macaca fascicularis
TVIRHHVLTWVKYIVGYLFPLLTMSICYLCLILKVKK

SEQ ID NO: 3587 - protein, 670 aa, Macaca fascicularis
MAGQFCLPVSPRLSPLKPLKPHFGDIQVGIYVAIQRSDKRMHLAVVTEINRENSWVTVEWVEKAVKKGKKIDLETILLLNPSLDSAEDPMPVSPLAPAPSSAIGDQSTTTKRVVMIPQKNKTASGDSLDVRVPSKPCLMKQKKSPCLQEIEKVQKQREKRRRLQQEIRARRALDVNTRNPNYEIMHMIEEYRRHLDSSKISVLEPRQEHRICVCVRKRPLNQRETTLKDLDIITVPSDNVVMVHESKQKVDLTRYLENQTFCFDHAFDDKASNELVYQFTAQPLVESIFRKGMATCFAYGQTGSGKTYTMGGDFAGRAQDHSKGIYALVAQDVFLLLRNSIYEKLDLKVYGTFFEIYGGKVYDLLNWKKKLQVLEDGNQQIQVVGLQEQEVCCVEEVLNLVELGNSCRTSRQTSVNAHSSRSHAVFQIILKSGGKLHGKFSLVDLAGNERGADTTKASRKRQLEGAEINKSLLALKECILALGQNKPHTPFRASKLTQVLRDSFIGRNSSTCMIATISPGMTSCENTLNTLRYANRVKELNADGRPYHRGLYPNGHEASRMLKSHIGNSEMSLQRDEFIKIPCVQSEEQQKEIEDVERATLLGKDTTTSRKGSSQWLENIQERTGGVNHDVDFCIAQSLSILEQKIGVLTEIQKKLKLLRADLHVKSKVE

SEQ ID NO: 3588 - protein, 124 aa, Capra hircus
KKTQTWIITCIYLQLLLFNPLVHSQGICRNRVTDDVKDVTKLVANLPKDYMITLKYVPGMDVLPSHCWISEMVEQLSVSLTDLLDKFSNISEGLSNYSIIDKLVKIVDDLVECMEEHSFENVKK

SEQ ID NO: 3589 - protein, 66 aa, Capra hircus
KKTQTWIITCIYLQLLLFNPLVHSQGICRNRVTDDVKDVTKLVANLPKDYMITLKYVPGMDVLPSH

SEQ ID NO: 3590 - protein, 30 aa, Equus caballus
TKLVANLPKDYKITLKYVPGMDVLPSHCWI

SEQ ID NO: 3591 - protein, 86 aa, Equus caballus
ITCIYLQLLLFNPLVKTKGICENRVTDDVKDVTKLVANLPKDYKITLKYVPGMDVLPSHCWISEMVQHLSVSLTDLLEKFSNISEG

SEQ ID NO: 3592 - protein, 340 aa, Sus scrofa
  MOD_RES (182)..(182): Any amino acid
  MOD_RES (281)..(281): Any amino acid
MDGVRNLTVSCASSNTCNDTIDDFRNQVYSTLYSMITVVGFFGNGFVLYVLIKTYHEKSAYQVYMINLAVADLLCVCTLPLRVVYYVHKGIWLFGDFLCRLSTYALYVNLYCSIFFMTAMSFFRCIAIVFPVQNINLITHKKAKIVCIAIWIFVILTSSPFLMSTSYKDEKNNTKCFEPPQXNQAKYHVLVLHYVSLFVGFIIPFVIIIVCYTMIILTLLKNSMKKNISSRKKAIGMIIVVTAAFLISFMPYHIQRTIHLHFLHNDTKHCDSVLRMQKSVXITLSLAASNCCFDPLLYFFSGGNFREGLSTFRKHSLSTMTYVPKKKTSLPEKAQEIYKE

SEQ ID NO: 3593 - protein, 345 aa, Sus scrofa
  MOD_RES (105)..(105): Any amino acid
MERKLMSLLPSISLSEMEPNSTLGNHNSNRSCTTENFKREFYPIVYLVIFIWGALGNGFSIYVFLKPYKKSTSVNVFMLNLAISDLLFTITLPFRVDYYLRGSNXIFGDTPCRIMSYSMYVNMYSSIYFLTVLSVVRFLATVHPFRLLHTTSIKNAWILCGVIWIFIMASSTVLLKNGSEQKDNVTLCLELNSNKVTKLKTMNYVALVVGFVLPFGTLSICYLLIIRALLKVEVPESGLRLSHRKALITVIIALIIFLLCFLPYHVLRTLHLLEWKADKCKDRLHKAVAVTLALAAANSCFNPFLYYFAGENFKDRLKSALRKGRPQKTRCGFSVCVWLKKETRV

SEQ ID NO: 3594 - protein, 167 aa, Sus scrofa
HTTSIKNAWILCGVIWIFIMASSTVLLKNGSEQKDNVTLCLELNSNKVTKLKTMNYVALVVGFVLPFGTLSICYLLIIRALLKVEVPESGLRLSHRKALITVIIALIIFLLCFLPYHVLRTLHLLEWKADKCKDRLHKAVAVTLALAAANSCFNPFLYYFAGENFKD

SEQ ID NO: 3595 - protein, 123 aa, Sus scrofa
FIMASSTVLLKNGSEQKDNVTLCLELNSNKVTKLKTMNYVALVVGFVLPFGTLSICYLLIIRALLKVEVPESGLRLSHRKALITVIIALIIFLLCFLPYHVLRTLHLLEWKADKCKDRLHKAV

SEQ ID NO: 3596 - protein, 84 aa, Caenorhabditis elegans
TCLGQALEYIHELGIVHRDVKLENLLIVKDEFGELGVKLADFGLAAEMPKDFGVLSTICGTPTYVAPEVLNKTGYGCKVDIWAA

SEQ ID NO: 3597 - protein, 120 aa, Caenorhabditis elegans
MTPYGTHMASEVLNVSSNNLDKSAQKTEQKKDKNVNIHGVWLHLLSDAFGSVIVMISAGFVYFLPTWKIAAYLDPILSISLASIMGFTAVVLVKTSGEKLLKQTPEGLDLEKVKKDLCSI

SEQ ID NO: 3598 - protein, 115 aa, Caenorhabditis elegans
AAYLDPILSISLASIMGFTAVVLVKTSGEKLLKQTPEGLDLEKVKKDLCSIVGVSKVEKLSVWTLCGQRIIAAAHVNICHPAVFPEAAYKIKNYFHDLGVHSTTIEPTFEDTCMQ

SEQ ID NO: 3599 - protein, 120 aa, Caenorhabditis elegans; identical to SEQ ID NO: 3597

SEQ ID NO: 3600 - protein, 115 aa, Caenorhabditis elegans; identical to SEQ ID NO: 3598

SEQ ID NO: 3601 - protein, 111 aa, Caenorhabditis elegans
GVMRPLVYRDKFTLKTIYIIAFAIVLFSVCVAIPFGLFQAADEIDGPIKCDSESCELIVKWLLFCIACLILMGCTGTLLFVTVSLHWHSYKSKKMGNVSSSAFNHGKSRLT

SEQ ID NO: 3602 - protein, 41 aa, Caenorhabditis elegans
IVKWLLFCIACLILMGCTGTLLFVTVSLHWHSYKSKKMGNV

SEQ ID NO: 3603 - protein, 516 aa, Drosophila melanogaster
MASSPITDFYAGRNVFITGATGFVGVTIVEKLLRDVPNVGTLYLLMRAKKGKSVQERLEELKKNSVFDKFKELQLQSRLSKIVPIEGDVGLEHLGISPKDRQTLIDNVNVVFHSAATLDFFQSLKETTNINLRGTRRVVELCQQIKNLDALVHVSSAYVNAYLTKVEEKLYPAPEDPEKIIQLSETLNDDALKELEPKLLKDHPNTYTFTKHLAEHEVANVASKFPCGIVRPSMITAAWKEPIPGWTISKNGPQGFFMGASKGVLRRLPLDPSIIMDYIPIDVVVNGIITTGYYVNSLQAKNGGRPADLQIFHLTSSTYKPFRFELMTDKINSYLHDYPLNSAVWYPNLRLVKSLWVFRLSAILFHFIPAIILDLVTKIGGGRPILVRLHKNVWNSLNTLEKFIFTEWHFDSKRLLALSKTLNIVDKKKFFIDIGELAWDEYFSNTILGVRQYLSKEPIKNLEKARRKDKILLGLHVALQLSFWYGVFKLIVCLTGISTAKAALVLPVLYYLFGLL

SEQ ID NO: 3604 - protein, 215 aa, Arabidopsis thaliana
MASIKVHGVPMSTATMRVLATLYEKDLQFELIPVDMRAGAHKQEAHLALNPFGQIPALEDGDLTLFESRAITQYLAEEYSEKGEKLISQDCKKVKATTNVWLQVEGQQFDPNASKLAFERVFKGMFGMTTDPAAVQELEGKLQKVLDVYEARLAKSEFLAGDSFTLADLHHLPAIHYLLGTDSKVLFDSRPKVSEWIKKISARPAWAKVIDLQKQ

SEQ ID NO: 3605 - protein, 67 aa, Arabidopsis thaliana
KCPQPELALGVEAHTDVSALTFILHNMVPGLQLFYEGKWVTAKCVPDSIVMHIGDTLEILSNGKYKS

SEQ ID NO: 3606 - protein, 64 aa, Arabidopsis thaliana
TDVSALTFILHNMVPGLQLFYEGKWVTAKCVPDSIVMHIGDTLEILSNGKYKSILHRGLVNKEK

SEQ ID NO: 3607 - protein, 504 aa, Arabidopsis thaliana
MSILLCFLCLLPVFLVSLSILSKRLKPSKWKLPPGPKTLPIIGNLHNLTGLPHTCFRNLSQKFGPVMLLHFGFVPVVVISSKEGAEEALKTQDLECCSRPETVATRMISYNFKDIGFAPYGEEWKALRKLVVMELLNTKKFQSFRYIREEENDLLIKKLTESALKKSPVNLKKTLFTLVASIVCRLAFGVNIHKCEFVDEDNVADLVNKFEMLVAGVAFTDFFPGVGWLVDRISGQNKTLNNVFSELDTFFQNVLDDHIKPGRQVSENPDVVDVMLDLMKKQEKDGESFKLTTDHLKGIISDIFLAGVNTSAVTLNWAMAELIRNPRVMKKVQDEIRTTLGDKKQRITEQDLSQVHYFKLVVKEIFRLHPAAPLLLPRETMSHVKIQGYDIPVKTQMMINIYSIARDPKLWTNPDEFNPDRFLDSSIDYRGLNFELLPFGSGRRICPGMTLGITTVELGLLNLLYFFDWVVPVGKNVKDINLEETGSIIISKKTTLELVPLVHH

SEQ ID NO: 3608 - protein, 438 aa, Neosartorya fumigata
MPISKIHARSVYDSRGNPTVEVDVVTETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENAVYAGSKFRTAVNL

SEQ ID NO: 3609 - protein, 438 aa, Penicillium citrinum
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 3610 - protein, 1687 aa, Fundulus heteroclitus
MRVLVLALTVALVAGNQVSYAPEFAPGKTYEYKYEGYILGGLPEEGLAKAGVKIQSKVLIGAAGPDSYILKLEDPVISGYSGIWPKEVFHPATKLTSALSAQLLTPVKFEYANGVIGKVFAPPGISTNVLNVFRGLLNMFQMNIKKTQNVYDLQETGVKGVCKTHYILHEDSKADRLHLTKTTDLNHCTDSIHMDVGMAGYTEKCAECMARGKTLSGAISVNYIMKPSASGTLILEATATELLQYSPVNIVNGAVQMEAKQTVTFVDIRKTPLEPLKADYIPRGSLKYELGTEFLQTPIQLLRITNVEAQIVESLNNLVSLNMGHAHEDSPLKFIELIQLLRVAKYESIEALWSQFKTKIDHRHWLLSSIPAIGTHVALKFIKEKIVAGEVTAAEAAQAIMSSTHLVKADLEAIKLQEGLAVTPNIRENAGLRELVMLGFGIMVHKYCVENPSCPSELVRPVHDIIAKALEKRDNDELSLALKVLGNAGHPSSLKPIMKLLPGFGSSASELELRVHIDATLALRKIGKREPKMIQDVALQLFMDRTLDPELRMVAVVVLFDTKLPMGLITTLAQSLLKEPNLQVLSFVYSYMKAFTKTTTPDHSTVAAACNVAIRILSPRFERLSYRYSRAFHYDHYHNPWMLGAAASAFYINDAATVLPKNIMAKARVYLSGVSVDVLEFGARAEGVQEALLKARDVPESADRLTKMKQALKALTEWRANPSRQPLGSLYVKVLGQDVAFANIDKEMVEKIIEFATGPEIRTRGKKALDALLSGYSMKYSKPMSAIEVRHIFPTSLGLPMELSLYTAAVTAASVEVQATISPPLPEDFHPAHLLKSDISMKASVTPSVSLHTYGVMGVNSPFIQASVLSRAKDHAALPKKMEARLDIVKGYFSYQFLPVEGVKTIASARLETVAIARDVEGLAAAKVTPVVPYEPIVSKNATLNLSQMSYYLNDSISASSELLPFSLQRQTGKNKIPKPIVKKMCATTYTYGIEGCVDIWSRNATFLRNTPIYAIIGNHSLLVNVTPAAGPSIERIEIEVQFGEQAAEKILKEVYLNEEEEVLEDKNVLMKLKKILSPGLKNSTKASSSSSGSSRSSRSRSSSSSSSSSSSSSSRSSSSSSRSSSSLRRNSKMLDLADPLNITSKRSSSSSSSSSSSSSSSSSSSSSSKTKWQLHERNFTKDHIHQHSVSKERLNSKSSASSFESIYNKITYLSNIVSPVVTVLVRAIRADHKNQGYQIAVYYDKLTTRVQIIVANLTEDDNWRICSDSMMLSHHKVMTRVTWGIGCKQYNTTIVAETGRVEKEPAVRVKLAWARLPTYIRDYARRVSRYISRVAEDNGVNRTKVASKPKEIKLTVAVANETSLNVTLNTPKNTFFKLGWVLPFYLPINNTAAELQAFQGRWMDQVTYMLTKSAAAECTVVEDTVVTFNNRKYKTETPHSCHQVLAQDCTSEIKFIVLLKRDQTAERNEISIKIENIDVDMYPKDNAVVVKVNGVEIPLTNLPYQHPTGNIQIRQREEGISLHAPSHGLQEVFLSLNKVQVKVVDWMRGQTCGLCGKADGEVRQEYSTPNERVSRNATSFAHSWVLPAKSCRDASECYMQLESVKLEKQISLEGEESKCYSVEPVWRCLPGCAPVRTTSVTVGLPCVSLDSNLNRSDSLSSIYQKSVDVSETAESHLACRCTPQCA

SEQ ID NO: 3611 - protein, 138 aa, Gallus gallus
LHGSILFLTCISVQRYMGICHPLASWHKKKGKKLTWLVCAAVWFIVIAQCLPTFVFASTGTQRNRTVCYDLSPPDRSTSYFPYGITLTITGFLLPFAAILACYCSMARILCQKDELIGLAVHKKKDKAVRMIIIVVIV

SEQ ID NO: 3612 - protein, 32 aa, Gallus gallus
LASWHKKKGKKLTWLVCAAVWFIVIAQCLPTF

SEQ ID NO: 3613 - protein, 333 aa, Pelodiscus sinensis
MATLQEKLITPIVAGSTTPNNKITVVGVGQVGMACAISILGKGLCDELALVDVLEDKLKGEMMDLQHGSLFLQTHKIVADKDLRVTANSKIVVVTAGVRQQEGESRLNLVQRNVNVFKFIIPQIMKYSPNCTILVVSNPVDILTYVTWKLSGLPKHRVIGSGCNLDSARFRHLMAEKLGIHPTSCHGWILGEHGDSSVAVWSGVNVAGVSLQELNPAMGTDKDSENWKEVHKMVVDSAYEVIKLKGYTNWAIGLSVADLIESYVKNLCRVHPVSTMVKGMYGIENEVFLSLPCVLSASGLTSVINQKLKDEEVAQLRKSADTLWSIQKDLKDL

SEQ ID NO: 3614 - protein, 332 aa, Pelodiscus sinensis
MSVKELLIQNVHKEEHSHAHNKITVVGVGAVGMACAISILMKDLADELALVDVIEDKLRGEMLDLQHGSLFLRTPKIVSGKDYSVTAHSKLVIITAGARQQEGESRLNLVQRNVNIFKFIIPNVVKYSPDCMLLVVSNPVDILTYVAWKISGFPKHRVIGSGCNLDSARFRYLMGEKLGIHSLSCHGWIIGEHGDSSVPVWSGVNVAGVSLKALYPDLGTDADKEHWKEVHKQVVDSAYEVIKLKGYTSWAIGLSVADLAETVMKNLRRVHPISTMVKGMYGVSSDVFLSVPCVLGYAGITDVVKMTLKSEEEEKLRKSADTLWGIQKELQF

SEQ ID NO: 3615 - protein, 333 aa, Caiman crocodilus
  Caiman crocodilus apaporiensis
MATLKEKLITHIASESTIPNNKVTVVGVGQVGMACAVSILGKSLCDELALVDVLEDKLKGEMMDLQHGSLFLQTHKIVADKDYAVTANSKIVVVTAGVRQQEGESRLNLVQRNVNVFKFIIPQIIKYSPDCIILVVSNPVDILTYVTWKLSGLPKHRVIGSGCNLDSARFRYLMSEKLGIHPSSCHGWILGEHGDSSVAVWSGVNVAGVSLQELNPAMGTDRDSEKWKEVHKQVVESAYEVIKLKGYTNWAIGFSVADLLETMMKNLNRVQPVSTMVKGMYGIENEVFLSLPCVLSASGLTSVINQKLKDDEVAQLRSSADTLWSIQKDLKDL

SEQ ID NO: 3616 - protein, 160 aa, Mus musculus; identical to SEQ ID NO: 447

SEQ ID NO: 3617 - protein, 160 aa, Mus musculus; identical to SEQ ID NO: 447

SEQ ID NO: 3618 - protein, 374 aa, Mus musculus
MSVPAFIDISEEDQAAELRAYLKSKGAELSEENSEGGLHVDLAQIIEACDVCLKEDDKDVESVMNSVVSLLLILEPDKQEALIESLCEKLVKFREGERPSLRLQLLSNLFHGMDKNTPVRYTVYCSLIKVAASCGAIQYIPTELDQVRKWISDWKLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 3619 - protein, 793 aa, Mus musculus
MEHHCGLITSNKETVPLKNISVTLSINEFVAAVVATLNYENEEKVPLEATFVFPMDEDSAVYSFEALVDGKKIVAELQDKMKAHSEYEEALSQGHQAYLLEEDDYSRDVFSCNVGNLQPGAKVAVTLRYVQELPLETDGALRYLLPAILNPRYQLSEQSANSCLNIQKPTVPLEDLPYTLNMTATITSQHGIERVQSNCSLSPIQYLTDDKTSAQVSLTEGHKFDRDVELLIYYNEVHSPSVAVEMGMLDMKPDSLMGAPSAMVSFYPDIPEVEASKACGEFVFLMDRSGSMDSPMSTENNSQLRIEAAKETLLLLLKSLPMGCYFNIYGFGSSYEKFFPESVKYTQDTMEDAVKRVKALKANLGGTEILTPLCNIYKASSIPGHPLQLFVFTDGEVSDTFSVIREVKLNSKKHRCFSFGIGQGASTSLIKNIARVSGGTAVFITGKDRMQTKALGSLKFALQCAVDNISLSWDLPPGLSVKMLSPEQLTIFRGQRLIIYAQLTGLMPQVESTGAVCLKHILQGRSLENRVTFSLQPKANDNFTIHRLAAKSLIQTKDFGSQEASKEEKEDVMNISLQSGVLSSFTAFIAINKELNKPVQGPLAHRVIPRPVMAGSSSMRFYSSFSGGFKGPQPRSLRVPAYDLCSAESANLVLKKSACSAIQKKKTNSSTNKSNLKKEHKAFGENAVVQLISLQKANGSWELDEDLTKILGTKSKDIKAANPAKHEDPSAWSTVLAVVWLHANGTDLKCEWELLERKAVAWLHDHAGSSIPMLVQAANSLLKLSVNPAVFGV

SEQ ID NO: 3620 - protein, 333 aa, Mus musculus
MFRAAAPGQLRRAASLLRFQSTLVIAEHANDSLAPITLNTITAAGRLGGEVSCLVAGTKCDKVVQDLCKVAGVAKVLVAQHDAYKGLLPEELTPLILETQKQFSYTHICAGASAFGKNLLPRVAAKLNVAPVSDIIEIKSPDTFVRTIYAGNALCTVKCDEKVKVFSVRGTSFEAAATSGGSASSEKAPSSSSVGISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 3621 - protein, 305 aa, Mus musculus
MEDGELIEYFKSQMKGDPKMASAVAAIQTLLEFLKRDKGETLQGLRANLTYAIKTLCGVDSSVAVSSGGELFLRFISLTSLEYSDYSKCKKIMIERGELFLRRISLSRNKIANLCHTFIKDGARILTHAYSRVVLRVLEEAVAAKKRFSVYITESQPDLSGKKMAKALSHLNVPVTVVLDAAVGYIMEKADLVIVGAEGVVENGGIINKIGTNQMAVCAKAQNKPFYVVAESFKFVRLFPLNQEDVPDKFKYKADTLKSVQTGQDLKEEHPWVDYTSPSLITLLFTDLGVLTPSAVSDELIKLYL

SEQ ID NO: 3622 - protein, 254 aa, Mus musculus
MAAGAVAWLLLWAAWLVGRLAADFSDAPFSAGKGVRATCSEIILRQEFLKDGFHRDLLIKVKFGESIEDLQTCRLLIKHYIPPGLFVDPYELASLRERNLTEAVMLSESFNIEAPNYLSNESAVLIYARQDAQCIDCFQAFLPVHYRYHRPHKKDGDTLIVVNNPDLLMYCDQEFPILKCWAQSEVAAPCALKSEEICQWKSMQYKSILKNLTVQVPVGLTIHTSLVCSVTLLITILCSTLILLAVFKYGHFSL

SEQ ID NO: 3623 - protein, 95 aa, Mus musculus
AFLPVHYRYHRPHKKDGDTLIVVNNPDLLMYCDQEFPILKCWAQSEVAAPCALKSEEICQWKSMQYKSILKNLTVQVPVGLTIHTSLVCSVTLLI

SEQ ID NO: 3624 - protein, 60 aa, Mus musculus
KSEEICQWKSMQYKSILKNLTVQVPVGLTIHTSLVCSVTLLITILCSTLILLAVFKYGHF

SEQ ID NO: 3625 - protein, 150 aa, Mus musculus
MLSESFNIEAPNYLSNESAVLIYARQDAQCIDCFQAFLPVHYRYHRPHKKDGDTLIVVNNPDLLMYCDQEFPILKCWAQSEVAAPCALKSEEICQWKSMQYKSILKNLTVQVPVGLTIHTSLVCSVTLLITILCSTLILLAVFKYGHFSL

SEQ ID NO: 3626 - protein, 394 aa, Rattus norvegicus
MLPAMKTVEAEEEYAEDCPELVPIETKHQEKEENLDFIIKIPVTIVTGYLGAGKTTLLNYILTEQHNRKIAVILNEFGEGSAVEKSLAVSQGGELYEEWLELRNGCLCCSVKDNGLKAIENLMQKKGKFDYILLETTGLADPGAVASMFWVDAELGSDIYLDGIITVVDSKYGLKHLTEEKPDGLVNEATRQVALADMILINKTDLVSEEELNKLRTTIRSINGLGKVLETQRSRTHLSNILDLHAYDTLSGISLQKKLQHVSTAPHLDQSIVTVTFDVPGSAEEESLNVFIQNLLWEKNVKNKDGRCMEVIRLKGLVSIKDKPQQMIVQGIHELYELEESRVNWKDDAERACQLVFIGKNLDKDILQQLFITAVAETKEQTTAPGQDGACPPH

SEQ ID NO: 3627 - protein, 48 aa, Mus musculus
LTNGQPTKENIHDCMKLKSPLGAKWHMAVTYVDSCLFVAVLVILIGCY

SEQ ID NO: 3628 - protein, 50 aa, Mus musculus
LTNGQPTKENIHDCMKLKSPLGAKWHMAVTYVDSCLFVAVLVILIGCYIA

SEQ ID NO: 3629 - protein, 1060 aa, Mus musculus
MKSEPYSEELLKDIPHLAHLCSLKDIVPYNSTEGWEKEAKVEFLKMVNKKAVLMKVFGEEDDVLIVDLQKPPTNKISSDMPVSLRDALVFMELARFRSQSPRSHSEKNTTLCYHPPILPEEMTEVSVMVCHINSPTDFYLQLMENLDFLSLLKTIEEFYKGEDGENLEILCPLQNQACVAKFEDGIWYRAKVIGLPGHREVEVKYVDFGNTAKITLKDMRKIKDEFLEPPEKAIKCKLAYVEPSKKSQWSKKAKEKFEEKTQDKFVTCSVIKILENNVLLVELFDSRAPGKSAVSINDQLVKEGLASYEAGYTLKDNSKKHLEVWDPSPEEIITSEINNLSPLSVKSLPNENFQSLYNKELPVNICNVISPEKIYVQWLLTENLLNSLEEKMVAAYEHSEWKPVKWECDMHCAVKVPAKNQWRRGQILRMVTDKLVEVLLYDVGVELVVNIHCLRELQENLKTMGRLSLECSLVDIRPTGGSDKWTATACDCLSLHLTGAIATIILQESNTTWPLPVKIFCRDEKGERVDVSKYLIKKGLALRERRVSKSSNSHSPEKSLEIPLEQGDSVVTKCFKINFDTNKKIADKVNEHKVPDSKGKKSESRSTGCYRPPAVPNTSSFEAIVTCIGDDGTIFVVPKLSEFELIKMMDEIQSNLKCLGLLEPYSWKKGEPCAVRGSDTLWYRGKVMEVVGGTIRVQYLDHGFTEKIPQCHLYPILLYPDTPQFCIPCQLYQTLPVGNTWQPDAIELLQELLSKREVDIHIMELPNNSWGKLSVHLYFDGMSLSHFMAHHKYCIFEHTEEIFKEKPRGQNKKYEDENWKIRFEDLLLPEMEAPVLPPYLSSLLPPPEELFAVQVKHIVSPDEMYICLDSEDSYTQFNHHGDTDDSGVSWESESENLEEALQRFNKNVETFPPLTDFSSEMPCLAEYADGLWYRAKIISIKEFNPLSVLVLFVDYGCTEKLTINRLRQIPVQLMQYPAQAIKVLLAGFKPPLSDSGKTRIPYCPKWSMEALWTMIDCLQGKQLYASSVAQAPEQIVTLYEDEQYPVHMSLVEMGLADKDE

SEQ ID NO: 3630 - protein, 303 aa, Mus musculus
MGSWKTGQSYLAAGLLKNQVAVVTGGGTGIGKAVSRELLHLGCNVVIASRKLDRLTAAVDELRASLPPSSSAEVSAIQCNIRKEEEVSNLVKSTLAKYGKINFLVNNGGGQFMAPVEDITAKGWHAVIETNLTGTFYMCKEVYNSWMREHGGSIVNIIVLLNNGFPTAAHTGAAREGVYNLTKSMALAWASSGVRINCVAPGTIYSQTAVDNYGEMGQTLFEMAFDSIPAKRLGVPEEISPLVCFLLSPAASYITGQLINVDGGQALYTHAFSIPDHDNWPVGAGDLSIVKRIKESFKKKAKL

SEQ ID NO: 3631 - protein, 96 aa, Mus musculus
TDKPQPFHQWQDSLKKHLKAEIKVMAAIQIMCAVMVLSLGIILASVPSNLHFTSVFSVLLKSGYPFIGALFFIVSGILSIVTETKSTKILVDSSLT

SEQ ID NO: 3632 - protein, 107 aa, Mus musculus
ETVAMISPNGMSLPQTDKPQPFHQWQDSLKKHLKAEIKVMAAIQIMCAVMVLSLGIILASVPSNLHFTSVFSVLLKSGYPFIGALFFIVSGILSIVTETKSTKILVD

SEQ ID NO: 3633 - protein, 80 aa, Mus musculus
GDVAVKILKVVDPTPEQLQAFRNEVAVLRKTRHVNILLFMGYMTKDNLAIVTQWCEGSSLYKHLHVQETKFQMFQLIDIA

SEQ ID NO: 3634 - protein, 74 aa, Mus musculus
KILKVVDPTPEQLQAFRNEVAVLRKTRHVNILLFMGYMTKDNLAIVTQWCEGSSLYKHLHVQETKFQMFQLIDI

SEQ ID NO: 3635 - protein, 468 aa, Mus musculus
MSYTFDWLSKDVVKKLQGRDLRPVKCLSDATKFCLFNILQETSSRLALKTEYIPVGFTLLHLLEPNIPVPEPEVSAPIPLKHTISQKLKADLDVETIAGGEAGFVKSCGYDIEVQSKSIPNPKLESLQNRKLLDQLPTFMKTCWKDGKNLYVVTEAYEVTKDTVLEGTSNSKFAIKGIINQLVKVGGSGQWQTEKTDSIPIQKGSVLAYKKQQLVIEDNTCVILTSANTKKKMTFPMRFVGMSGHLRYQDLVIETGSWINDIDPIGTIKEPTHLDFMCLQNEVSEQTRLLAELSKDVQEVVFSSFLHMLCDRDVLYDLMKMLELNQLGHMDGPGGKILDELRKDSSLSWINLKDLILYLLQALMVLSDTQLCLLALSVEMRLLPHQVELVKSILQPNFKYPWNIPFTLQPQLLAPLQGEGLAITYELLEECGLKMELNNPRSTWDLEAKMPLSALYGSLSFLQQLSEA

SEQ ID NO: 3636 - protein, 136 aa, Mus musculus; identical to SEQ ID NO: 402

SEQ ID NO: 3637 - protein, 195 aa, Mus musculus; identical to SEQ ID NO: 403

SEQ ID NO: 3638 - protein, 88 aa, Mus musculus
LTKLGWFEVQKDEFVFREIIADVKKFLQGTVEHCIIGVIILCELTQEMNLVDYSRPSAKHRKIATSFRDTSLKDILVLACSLLKQVLA

SEQ ID NO: 3639 - protein, 68 aa, Mus musculus
MSEVLGITDDNHVLETFMTKIVTNLKYWGRCEPVISRTLQFLSDLSVGYILLKKLVKIDAVKFMLKNH

SEQ ID NO: 3640 - protein, 199 aa, Mus musculus
MDDQKKRWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNSTIKELRRLFLVDDLVDSLKFAVLMWVFTYVGALFNGLTLLILALISLFSIPVIYERHQAQIDHYLGLANKSVKDAMAKIQAKIPGLKRKAE

SEQ ID NO: 3641 - protein, 372 aa, Staphylococcus aureus
MKIGIPREIKNNENRVGLSPSGVHALVESGHTVLVETNAGSGSFFEDVDYKEAGAEIVAEQAKVWDVDMVIKVKEPLESEYPYFKEGLVLFTYLHLANEEKLTQALIDRKVISIAYETVQLPDRSSPLLSPMSEVAGRMSAQVGAEFLQKLNGGMGILLGGVPGVPKGKVTIIGGGQAGTNAAKIALGLGADVTILDVNPKRLQQLDDLFGGRVHTIMSNPLNIELYVKQSDLVIGAVLIPGAKAPRLVTEDMIKQMKNGSVIIDIAIDQGGIFETTDKITTHDDPTYIKHGVVHYAVANMPGAVPRTSTLALNNATLPYALMLANKGYREAFKSNQPLSLGLNTYKGHVTNKGVAEAFEMEYKSVEEALQL

SEQ ID NO: 3642 - protein, 308 aa, Staphylococcus aureus; identical to SEQ ID NO: 3047

SEQ ID NO: 3643 - protein, 228 aa, Staphylococcus aureus; identical to SEQ ID NO: 2116

SEQ ID NO: 3644 - protein, 192 aa, Staphylococcus aureus; identical to SEQ ID NO: 3049

SEQ ID NO: 3645 - protein, 264 aa, Streptococcus pyogenes
MDTRPIGFLDSGVGGLTVVCELIRQLPHEKIVYIGDSARAPYGPRPKKQIKEYTWELVNFLLTQNVKMIVFACNTATAVAWEEVKAALDIPVLGVVLPGASAAIKSTTKGQVGVIGTPMTVASDIYRKKIQLLAPSIQVRSLACPKFVPIVESNEMCSSIAKKIVYDSLAPLVGKIDTLVLGCTHYPLLRPIIQNVMGPSVKLIDSGAECVRDISVLLNYFDINGNYHQKAVEHRFFTTANPEIFQEIASIWLKQKINVEHVTL

SEQ ID NO: 3646 - protein, 249 aa, Zea mays
MSPAPSRPRIRPWLVVGDLALAAAWVCAGALVKLLVYGGLGLGGRPEAEAVKVSLSLVYMFLFAWLEAASGGASYNPLTVLAAALASHGGPAVYLFTAFARIPAQVIGAVLGVKLIQVTFPNVGKGARLSVGAHHGALAEGLATFMVVMVSVTLKKKEMKSFFMKTWITSIWKNTIHLLSSDITGGIMNPASAFAWAYARGDHTTFDHLLVYWLAPLQATLLGVWAVTFFTKPKKIKEQKVDENKIKKE

SEQ ID NO: 3647 - protein, 118 aa, Zea mays
LEAASGGASYNPLTVLAAALASHGGPAVYLFTAFARIPAQVIGAVLGVKLIQVTFPNVGKGARLSVGAHHGALAEGLATFMVVMVSVTLKKKEMKSFFMKTWITSIWKNTIHLLSSDI

SEQ ID NO: 3648 - protein, 102 aa, Zea mays
LTVLAAALASHGGPAVYLFTAFARIPAQVIGAVLGVKLIQVTFPNVGKGARLSVGAHHGALAEGLATFMVVMVSVTLKKKEMKSFFMKTWITSIWKNTIHLL

SEQ ID NO: 3649 - protein, 71 aa, Oryza sativa
TDAIYYAGTGSLLCKAEDRVTIFDLQQRLILGELQAPSVKYVVWSSDMESVALLSKHAVVIANKKLVHRCT

SEQ ID NO: 3650 - protein, 160 aa, Oryza sativa
TGSLLCKAEDRVTIFDLQQRLILGELQAPSVKYVVWSSDMESVALLSKHAVVIANKKLVHRCTLHETIRVKSGAWDENGVFIYTTLNHIKYCLPNGDSGIIKTLDVPIYITRVIGNNIFCLDRDGKNKLVTVDASEYIFKLALLRKRYDHVMSMIKNSQL

SEQ ID NO: 3651 - protein, 71 aa, Oryza sativa
TDAIYYAGTGNLLCKAEDRVTIFDLQQRLILGELQAPSVKYVVWSSDMESVALLSKHAVVIANKKLVHRCT

SEQ ID NO: 3652 - protein, 160 aa, Oryza sativa
TGNLLCKAEDRVTIFDLQQRLILGELQAPSVKYVVWSSDMESVALLSKHAVVIANKKLVHRCTLHETIRVKSGAWDENGVFIYTTLNHIKYCLPNGDSGIIKTLDVPIYITRVIGNNIFCLDRDGKNKLVTVDASEYIFKLALLRKRYDHVMSMIKNSQL

SEQ ID NO: 3653 - protein, 290 aa, Arabidopsis thaliana
MAATSLLYNQLKAAEPFFLLAGPNVIESEEHILRMAKHIKDISTKVGLPLVFKSSFDKANRTSSKSFRGPGMAEGLKILEKVKVAYDLPIVTDVHESSQCEAVGKVADIIQIPAFLCRQTDLLVAAAQTGKIINIKKGQFCAPSVMENSAEKIRLAGNPNVMVCERGTMFGYNDLIVDPRNFEWMREANCPVVADITHSLQQPAGKKLDGGGVASGGLRELIPCIARTAVAVGVDGIFMEVHDDPLSAPVDGPTQWPLRHLEELLEELIAIARVTKGKQRLQIDLTPYRD

SEQ ID NO: 3654 - protein, 447 aa, Mus musculus
MKVTARLTWIEEKILEKLLGNASLTLLYQSSAHKNCVSEMTQKYSLQGSTMTVFHLEKDVVVGVFILENFPRLVSEKPCTCAWFSLKRNNSSGISALFLNTKVIVDSEELIIFSLDGLSLSVTPLRGFTLALNDTVMNGLELNLGHGFLPVECEIFRVDGIKKNPSFIKKMVTAEQHRGKLLSALRAYKPYKDLVSEVRILLVGPVGSGKSSFFNSVKSAFQGHLTRQAIVGSDESSITKQYRVYSIKDGKSGETLPFMLCDSMGLEEGEEAGLCIDDIPHILQGCVPDRYQFNPCEPMKPKHSPHAASPPLKDRIHCVAFVLHINSVNTLSDKMVAKLKKIRKDVVDCGIGYVALLTNVEEYDEVLDDSFANMTETVTSLSQVQNVQKWLNIPIANILMVSNYASERRLEPMKDILVFAALRQMLRAADDALEDLPLEDTGNLAPF

SEQ ID NO: 3655 - protein, 396 aa, Mus musculus
MKVTARLTWIEEKILEKLLGNASLTLLYQSSAHKNCVSEMTQKYSLQGSTMTVFHLEKDVVVGVFILENFPRLVSEKPCTCAWFSLKRNNSSGISALFLNTKVIVDSEELIIFSLDGLSLSVTPLRGFTLALNDTVMNGLELNLGHGFLPVECEIFRVDGIKKNPSFIKKMVTAEQHRGKLLSALRAYKPYKDLVSEVRILLVGPVGSGKSSFFNSVKSAFQGHLTRQAIVGSDESSITKQFNPCEPMKPKHSPHAASPPLKDRIHCVAFVLHINSVNTLSDKMVAKLKKIRKDVVDCGIGYVALLTNVEEYDEVLDDSFANMTETVTSLSQVQNVQKWLNIPIANILMVSNYASERRLEPMKDILVFAALRQMLRAADDALEDLPLEDTGNLAPF

SEQ ID NO: 3656 - protein, 332 aa, Macaca fascicularis
MATLKDQLIHNLLKEEQTPQNKITVVGVGAVGMACAISILMKDLADELALVDVIEDKLKGEMMDLQHGSLFLRTPKIVSGKDYSVTANSKLVIITAGARQQEGESRLNLVQRNVNIFKFIVPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTPEEEARLKKSADTLWGIQKELQF

SEQ ID NO: 3657 - protein, 319 aa, Sus scrofa
MASPKKKLQGLVAATITPMTEHGEINFSVIGQYVDYLVEVQGVKNIFVNGTTGEGLSLSISERCQVAEEWVTKGRNKLDQIVIHVGALSLKESQELAQHAAKIGADGIAVIAPFFLKPWNKDNLINFLKEVAAAAPALPFYYYHIPALTGVKIRAEELLDGIQDKIPTFQGLKFSDTDLLDFGQCVDQNHQRQFAFLFGVDEQLLSALVMGATGAVGSTYNYLGRKTNQMLEAFERKDFSSALNHQFCIQRFINFVVKLGFGVSQTKAIMTLVSGIPMGPPRLPLQKASREFTDNAKAKLKSLDVLSFTDLKDGNLEAC

SEQ ID NO: 3658 - protein, 162 aa, Bos taurus
MAPIKVGDAIPSVEVFEKEPGNKVNLAELFKGKKGVLFGLPGAFTPGCSKTHLPGFVEQADALKAKGIQVVACLTVNDVFVTEEWARAHKAEGKVRLLADPSGTFGKETDLLLDDSLLFLFGNHRLKRFSMVIEDGIVKSLNVEPDGTGLTCSLAPNILSQL

SEQ ID NO: 3659 - protein, 354 aa, Oryctolagus cuniculus
MAKLLLLTLLGASLAFVGERLLAFRNSFGAVQELEPVEPQNCVLIEGLENGSEDIDILPSGLAFISSGLKYPGMPNFAPDEPGKIFLIDMNEKNPRAQELEISNGFEKESFNPHGISTFIDKDHTVYLYVVNHPHMKSTVEIFKFEEQQRSLVHLKTIKHELLKSVNNIVVLGPEQFYATRDHYFTNYVLALLEMFLDLHWTSVLFYSPKEVKVVAKGFSSANGITVSLDKKYVYVADATAKNVHVMEKHDNWDLTELKVIHLDTLVDNLSVDPATGDILAGCHPNGMKLLNYNPEDPPGSEVLRIQNVLSEKPRVSTVYTNDGSVLQGSTVASVYQGKILIGTIFHKTLYCVL

SEQ ID NO: 3660 - protein, 399 aa, Pecten maximus
MTVKVCVCGGGNGAHTLSGLAASRDGVEVRVLTLFADEAERWTKALGADELTVIVNEKDGTQTEVKSRPKVITKDPEIAISGADVVILTVPAFAHEGYFQAMAPYVQDSALIVGLPSQAGFEFQCRDILGDKAAAVSMMSFETLPWACRIKEFGRKVEVLGTKSVLAASLIKGTAKTVDPLSTLQMLHGAEPVFRLAKHFLEMLIMSYSFVHPAILFGRWGSWDGKPVPEAPLFYQGIDQATADMLTACSNECKDVANAIMAACPGNDLSDVKDIYQWYLEYYHEDIQDDHDLYHAITTNKSYKGLVHPVKAVDGGVAPDFGNRYLTEDIPMGMIVFKGVAIAAGVAIPSNDKLIMWAQEKIGKEYLVDGALTGKDVATTRCPQRYGFNTLDAILTGKK

SEQ ID NO: 3661 - protein, 444 aa, Toxoplasma gondii
MVAIKDITARQILDSRGNPTVEVDLLTDGGCFRAAVPSGASTGIYEALELRDKDQTKFMGKGVMKAVENIHKIIKPALIGKDPCDQKGIDKLMVEELDGTKNEWGWCKSKLGANAILAVSMACCRAGAAAKGMPLYKYIATLAGNPTDKMVMPVPFFNVINGGSHAGNKVAMQEFMIAPVGASTIQEAIQIGAEVYQHLKVVIKKKYGLDATNVGDEGGFAPNISGATEALDLLMEAIKVSGHEGKVKIAADVAASEFFLQDDKVYDLDFKTPNNDKSQRKTGEELRNLYKDLCQKYPFVSIEDPFDQDDFHSYAQLTNEVGEKVQIVGDDLLVTNPTRIEKAVQEKACNGLLLKVNQIGTVSESIEACQLAQKNKWGVMVSHRSGETEDSFIADLVVGLRTGQIKTGAPCRSERLCKYNQLMRIEESLGSDCQYAGAGFRHPN

SEQ ID NO: 3662 - protein, 271 aa, Caenorhabditis elegans
MKAQLAILSLLVGLLAAQDLRSLLDICANPPKTTPKTLSDKISLPESYKISGSMTDWMKASTSLLVESASKEFRVLEKQTRDQMPEKWIQELTGAKLTSFINVTKTLSDLSQVGLNGLNEAVASSISKNVHPIIPYRVIVFYVESRDSGLEMIVRVAEKTEKKPGNVVGYNYTTELTTAEIFKLMNDSMTLDKMPIEVLKNNGVKEEWMADASTMKMYPPENDDGFIGYTGGAMFVLAIFCLLIGVSIGAVGVFVATRRQRISTLAYQVFE

SEQ ID NO: 3663 - protein, 96 aa, Schizosaccharomyces pombe
GDCCSAVASALLRHGRLTIPMLQKRTSLPGPKIRQALVSLMQHHMVLYVTVIENVREVTYYETQWKEIYNILRKGKDVYLISQKLNQEAASVVKYL

SEQ ID NO: 3664 - protein, 69 aa, Schizosaccharomyces pombe
LTIPMLQKRTSLPGPKIRQALVSLMQHHMVLYVTVIENVREVTYYETQWKEIYNILRKGKDVYLISQKL

SEQ ID NO: 3665 - protein, 526 aa, Schizosaccharomyces pombe
MHSLQCRRVIPFGKLSLSLHAPRNALRFVHKPAFTFESYKSLHRDPKYAKLSEQDVQVFKSIIGKDGSLIDGLDKSTDPADLDAFNIDWMNKYRGKTQLALKPKTTQQVSEILKYCNQKKLAVVPQGGNTGLVGGSVPVFDEIVLNLGLMNQIHTFDEISGVITLDSGVILENADNFLAEKGYMFPLDLGAKGSCQVGGCAATAAGGLRLLRYGSLHGSILGMEAVLPDGTILDNLVTLRKDNTGLDIKQLFIGSEGYLGVITKLSVICPKRPSSTNVAFFGVPSYENVLKAFSETRSHLTEILSAFELMDNTSQTLVDKYSGTQRPLEDEHPFYVLVETQGSNKEHDEQKITALVEDLLEKEIISDGVLAQDESQLRVLWERREGITECLAKAGSGVYKYDVSLPLPVLYDLVNDTKKRLIEFNLLDDTPEHPVIDVVGFGHMGDGNLHLNIAVRQFDKRVEKCLEPWVYEWVSRHRGSISAEHGLGLLKKPFVGYSKSKEMIHLMKTLKNVFDPNGIMLPYKYV

SEQ ID NO: 3666 - protein, 326 aa, Arabidopsis thaliana [sequence omitted]

SEQ ID NO: 3667 - protein, 1036 aa, Arabidopsis thaliana
MSLFHVLGFGVKIGHLFWMLCCWFVSWFVDNGIEDKSGLLVGSVGDLEKTKMTTLKKKNKMWFWNKISSSGLKIPSFSYQFLGSVKFNKAWWRKLVVVWVVFWVLVSIWTFWYFSSQAMEKRKETLASMCDERARMLQDQFNVSMNHVQAMSILISTFHHGKIPSAIDQRTFSEYTDRTSFERPLTSGVAYAMRVLHSEREEFERQQGWTIRKMYSLEQNPVHKDDYDLEALEPSPVQEEYAPVIFAQDTVSHVVSLDMLSGKEDRENVLRARSSGKGVLTAPFPLIKTNRLGVILTFAVYKRDLPSNATPKERIEATNGYLGGVFDIESLVENLLQQLASKQTILVNVYDITNHSQPISMYGTNVSADGLERVSPLIFGDPLRKHEMRCRFKQKPPWPVLSMVTSFGILVIALLVAHIIHATVSRIHKVEEDCDKMKQLKKKAEAADVAKSQFLATVSHEIRTPMNGVLGMLHMLMDTELDVTQQDYVRTAQASGKALVSLINEVLDQAKIESGKLELEEVRFDLRGILDDVLSLFSSKSQQKGVELAVYISDRVPDMLIGDPGRFRQILTNLMGNSIKFTEKGHIFVTVHLVDELFESIDGETASSPESTLSGLPVADRQRSWENFKAFSSNGHRSFEPSPPDINLIVSVEDTGVGIPVEAQSRIFTPFMQVGPSISRTHGGTGIGLSISKCLVGLMKGEIGFSSTPKVGSTFTFTAVFSNGMQPAERKNDNNQPIFSEFRGMKAVVVDHRPARAKVSWYHFQRLGIRVEVVPRVEQALHYLKIGTTTVNMILIEQEIWNREADDFIKKLQKDPLFLSPKLILLANSVESSISEALCTGIDPPIVIVKPLRASMLAATLQRGLGIGIREPPQHKGPPALILRNLLLGRKILIVDDNNVNLRVAAGALKKYGADVVCAESGIKAISLLKPPHEFDACFMDIQMPEMDGFEATRRIRDMEEEMNKRIKNGEALIVENGNKTSWHLPVLAMTADVIQATHEECLKCGMDGYVSKPFEAEQLYREVSRFFNSPSDTES

SEQ ID NO: 3668 - protein, 234 aa, Arabidopsis thaliana
MSTEIGHLRRRLVEFLIQSTTLLELPPIVKYSALSLFFDRFRPNLVRFLQKKKAEHWLLQPLNESNLQLFVLISIWISCKMHCTRGLSVHSLKSFGDKVITEQLFMVRDFLDAELVFLKVLKFEIGTLNIAYTRLEDLLIQFKEVAKVGEQLNFEACMDMMDLLYEKEDTSLLYQSSKSLAASILVSSYIITVPKQQYEFPILPWVKMVTNKEEREVVELVEYILAHVLYSNSP

SEQ ID NO: 3669 - protein, 254 aa, Arabidopsis thaliana
MADSKMKLHCGFIWGNSAALFCINEKGLDFELVFVDWLAGEAKTKTFLSTLNPFGEVPVLEDGDLKLFEPKAITRYLAEQYKDVGTNLLPDDPKKRAIMSMWMEVDSNQFLPIASTLIKELIINPYQGLATDDTAVQENKEKLSEVLNIYETRLGESPYLAGESFSLADLHHLAPIDYLLNTDEEELKNLIYSRPNVAAWVEKMKMRPAWLKTVVMKNHIVDLMKQRRLPIKLDSSCHESTVVAQKNAIAIENK

SEQ ID NO: 3670 - protein, 342 aa, Arabidopsis thaliana
MQQLMTLLSPPLSHSSLLPTVTTKFGSPRLVTTCMGHAGRKNIKDKVVLITGTTGTGKSRLSVDLATRFFPAEIINSDKMQIYKGFEIVTNLIPLHEQGGVPHHLLGQFHPQDGELTPAEFRSLATLSISKLISSKKLPIVVGGSNSFNHALLAERFDPDIDPFSPGSSLSTICSDLRYKCCILWVDVLEPVLFQHLCNRVDQMIESGLVEQLAELYDPVVDSGRRLGVRKTIGVEEFDRYFRVYPKEMDKGIWDLARKAAYEETVKGMKERTCRLVKKQKEKIMKLIRGGWEIKRLDATAAIMAELNQSTAKGEGKNGREIWEKHIVDESVEIVKKFLLEV

SEQ ID NO: 3671 - protein, 147 aa, Arabidopsis thaliana
DLLEDKSTETGRLCLFGFCSENCISSYNYGEKVMKNLEEVKELLSKKHFEVVAHKIPVPKVEEKNIHTTVGLYAMVEMAWKSLMNDEIRTLCLHGMGGVGKTTLLACINNKFVELESEFDVVIWVVVSKDFQLEGIQDQILGRLRLD

SEQ ID NO: 3672 - protein, 898 aa, Arabidopsis thaliana
MGISFSIPFDPCVNKVSQWLDMKVSYTHNLEKNLVALETTMEELKAKRDDLLRKLKREEDRGLQTLGEIKVWLNRVETIESRVNDLLNARNAELQRLCLCGFCSKSLTTSYRYGKSVFLKLREVEKLERRVFEVISDQASTSEVEEQQLQPTIVGQETMLDNAWNHLMEDGVGIMGLYGMGGVGKTTLLTQINNKFSKYMCGFDSVIWVVVSKEVNVENILDEIAQKVHISGEKWDTKYKYQKGVYLYNFLRKMRFVLFLDDIWEKVNLVEIGVPFPTIKNKCKVVFTTRSLDVCTSMGVEKPMEVQCLADNDAYDLFQKKVGQITLGSDPEIRELSRVVAKKCCGLPLALNVVSETMSCKRTVQEWRHAIYVLNSYAAKFSGMDDKILPLLKYSYDSLKGEDVKMCLLYCALFPEDAKIRKENLIEYWICEEIIDGSEGIDKAENQGYEIIGSLVRASLLMEEVELDGANIVCLHDVVREMALWIASDLGKQNEAFIVRASVGLREILKVENWNVVRRMSLMKNNIAHLDGRLDCMELTTLLLQSTHLEKISSEFFNSMPKLAVLDLSGNYYLSELPNGISELVSLQYLNLSSTGIRHLPKGLQELKKLIHLYLERTSQLGSMVGISCLHNLKVLKLSGSSYAWDLDTVKELEALEHLEVLTTTIDDCTLGTDQFLSSHRLMSCIRFLKISNNSNRNRNSSRISLPVTMDRLQEFTIEHCHTSEIKMGRICSFSSLIEVNLSNCRRLRELTFLMFAPNLKRLHVVSSNQLEDIINKEKAHDGEKSGIVPFPKLNELHLYNLRELKNIYWSPLPFPCLEKINVMGCPNLKKLPLDSKSGKHGGNGLIITHREMEWITRVEWEDEATKTRFLANRSSFSSSLICFSNDLVSRDMNCFHL

SEQ ID NO: 3673 - protein, 109 aa, Arabidopsis thaliana
QGLKTHALAIKNGLFNSVFLKTSLVDMYFKCGKVGLARRVFDEIVERDIVVWGAMIAGLAHNKRQWEALGLFRTMISEEKIYPNSVILTTILPVLGDVKALKLGKEVHA

SEQ ID NO: 3674 - protein, 70 aa, Arabidopsis thaliana
VTMGRVLTVCSDLKALKLGKELHGHILKKEFESIPFVSARIIKMYGKCGDLRSANFSFDAVAVKGSLTWT

SEQ ID NO: 3675 - protein, 133 aa, Arabidopsis thaliana
EMLVAGFQPNSITLASILPLCARIANLQHGKEFHCYILRRKCFKDYTMLWNSLVDVYAKSGKIVAAKQVSDLMSKRDEVTYTSLIDGYGNQGEGGVALALFKEMTRSGIKPDHVTVVAVLSACSHSKLVHEGE

SEQ ID NO: 3676 - protein, 117 aa, Arabidopsis thaliana
ITLASILPLCARIANLQHGKEFHCYILRRKCFKDYTMLWNSLVDVYAKSGKIVAAKQVSDLMSKRDEVTYTSLIDGYGNQGEGGVALALFKEMTRSGIKPDHVTVVAVLSACSHSKL

SEQ ID NO: 3677 - protein, 29 aa, Arabidopsis thaliana
VTVEIMHAMWKPQKFKAIYLLATIYVLTL

SEQ ID NO: 3678 - protein, 70 aa, Arabidopsis thaliana
GDKLLTHSNALSLLPKTGFRDTAVILMLIHQFITFGFASTPLYFVWEKLIGVHETKSMFKRAMARLPVVV

SEQ ID NO: 3679 - protein, 360 aa, Arabidopsis thaliana
MMRSVAVIGKKCLHRHTVLLKGNPRTTLCWERSFAGASSDDCRENLSRKVLQDLKLDDAIGLFGDMVKSRPFPSIVEFSKLLSAIAKMNKFDLVISLGEQMQNLGISHNLYTYSIFINYFCRRSQLSLALAILGKMMKLGYGPSIVTLNSLLNGFCHGNRISEAVALVDQMVEMGYQPDTVTFTTLVHGLFQHNKASEAVALVERMVVKGCQPDLVTYGAVINGLCKRGEPDLALNLLNKMEKGKIEADVVIYNTIIDGLCKYKHMDDAFDLFNKMETKGIKPDVFTYNPLISCLCNYGRWSDASRLLSDMLEKNINPDLVFFNALIDAFVKEGKLVEAEKLYDEMVKRSIDPSFVCTIV

SEQ ID NO: 3680 - protein, 248 aa, Mus musculus
MGLSRVRAVFFDLDNTLIDTAGASRRGMLEVIKLLQSKYHYKEEAEIICDKVQVKLSKECFHPYSTCITDVRTSHWEEAIQETKGGADNRKLAEECYFLWKSTRLQHMILADDVKAMLTELRKEVRLLLLTNGDRQTQREKIEACACQSYFDAIVIGGEQKEEKPAPSIFYHCCDLLGVQPGDCVMVGDTLETDIQGGLNAGLKATVWINKSGRVPLTSSPMPHYMVSSVLELPALLQSIDCKVSMSV

SEQ ID NO: 3681 - protein, 519 aa, Mus musculus
MYLLPLPAAARVALRRLGVRGLWDRGLSTADMTKGLVLGIYAKDKDDDLPQFTSAGESFNKLVSGKLREMLNISGPPLKAGKTRTFYGLHQDFPSVVVVGLGKRSAGVDDQENWHEGKENIRAAVAAGCRQVQDLELPSVEVDPCGDAQAAAEGAVLGLYEYDDLKQKKKVAVSAKLHGSGDLEAWEKGVLFASGQNLARHLMESPANEMTPTRFAEIIEKNLKSASSKTKVHIRPKSWIEEQEMGSFLSVAKGSEEPPVFLEIHYMGSPNATEAPLVFVGKGITFDSGGISIKASANMDLMRADMGGAATICSAIVSAAKLNLPINIIGLAPLCENMPSGKANKPGDVVRARNGKTIQVDNTDAEGRLILADALCYAHTFNPKVIINAATLTGAMDVALGSGATGVFTNSSWLWNKLFEASVETGDRVWRMPLFEHYTRQVIDCQLADVNNLGKYRSAGACTAAAFLREFVTHTKWAHLDIAGVMTNKDEIPYLRKGMSGRPTRTLIEFLLRFSKDSS

SEQ ID NO: 3682 - protein, 488 aa, Mus musculus
MTKGLVLGIYAKDKDDDLPQFTSAGESFNKLVSGKLREMLNISGPPLKAGKTRTFYGLHQDFPSVVVVGLGKRSAGVDDQENWHEGKENIRAAVAAGCRQVQDLELPSVEVDPCGDAQAAAEGAVLGLYEYDDLKQKKKVAVSAKLHGSGDLEAWEKGVLFASGQNLARHLMESPANEMTPTRFAEIIEKNLKSASSKTKVHIRPKSWIEEQEMGSFLSVAKGSEEPPVFLEIHYMGSPNATEAPLVFVGKGITFDSGGISIKASANMDLMRADMGGAATICSAIVSAAKLNLPINIIGLAPLCENMPSGKANKPGDVVRARNGKTIQVDNTDAEGRLILADALCYAHTFNPKVIINAATLTGAMDVALGSGATGVFTNSSWLWNKLFEASVETGDRVWRMPLFEHYTRQVIDCQLADVNNLGKYRSAGACTAAAFLREFVTHTKWAHLDIAGVMTNKDEIPYLRKGMSGRPTRTLIEFLLRFSKDSS

SEQ ID NO: 3683 - protein, 181 aa, Mus musculus
MFKKFDEKESVSNCIQLKTSVIKGIKSQLTEQFPGIEPWLNQIMPKKDPVKIVRCHEHMEILTVNGELLFFRQRKGPFYPTLRLLHKYPFILPHQQVDKGAIKFVLSGANIMCPGLTSPGAKLYTAAVDTIVAVMAEGKEHALCVGVMKMAAADIEKINKGIGIENIHYLNDGLWHMKTYK

SEQ ID NO: 3684 - protein, 135 aa, Mus musculus
MVLDSVARIVKVQLPAYLKQLPVPDSITGFARLTVSDWLRLLPFLGVLALLGYLAVRPFFPKKKQQKDSLINLKIQKENPKVVNEINIEDLCLTKAAYCRCWRSKTFPACDGSHNKHNELTGDNVGPLILKKKEV

SEQ ID NO: 3685 - protein, 120 aa, Mus musculus
MSIVRSSVHAKWVVGKVIGTAMIKTAKVRATRLVLDPYLLKYFNKRKTYFAHDALQQCSVGDIVLLRALPVPRSKHVKHELAEIIFKVGRVIDPVTGKPCAGTAYLESPLSEPREELKVS

SEQ ID NO: 3686 - protein, 77 aa, Mus musculus
IAQKTCFIILSKLVELWGGKDGPVGFADFVYKHIVPACFLAPLKQTFDLADAQTVLALSECAVTLKTIHLKRGPECV

SEQ ID NO: 3687 - protein, 71 aa, Mus musculus
IILSKLVELWGGKDGPVGFADFVYKHIVPACFLAPLKQTFDLADAQTVLALSECAVTLKTIHLKRGPECVQ

SEQ ID NO: 3688 - protein, 314 aa, Mus musculus
MSSTAAFCLLSTLGGYLVTSFLLLKYPALLHQRKKQRFLSRHISHRGGAGENLENTMAAFQHAVTIGTDMLELDCHITKDEQVVVSHDANLKRSTGVNVNVSDLKYCELPPYLCKLDVPFQRACKCEGKDTRIPLLKEVFEAFPETPINIDIKVNNNVLIKKVSELVKQYKREHLTVWGNANSEIVDKCYKENSDIPILFSLQRVLLILGLFFTGLLPFVPIREQFFEIPMPSIILKLKEPHTISKGHKFLIWLSDTLLMRKALFDHLTARGIQVYVWVLNEEYEYKRAFDLGATGVMTDYPTKLKDFLNNFSA

SEQ ID NO: 3689 - protein, 200 aa, Mus musculus
TMAAFQHAVTIGTDMLELDCHITKDEQVVVSHDANLKRSTGVNVNVSDLKYCELPPYLCKLDVPFQRACKCEGKDTRIPLLKEVFEAFPETPINIDIKVNNNVLIKKVSELVKQYKREHLTVWGNANSEIVDKCYKENSDIPILFSLQRVLLILGLFFTGLLPFVPIREQFFEIPMPSIILKLKEPHTISKGHKFLIWLS

SEQ ID NO: 3690 - protein, 108 aa, Mus musculus
DVRQLITLYGILPLGSAEVHERAPLVKSLLLAGPSGVGKKMLVHAICTETGANLFNLSALNIAGKYPGKTGLQMMIHLVFKVARQLQPSVVWIQDTEKTFYKKVPQAE

SEQ ID NO: 3691 - protein, 99 aa, Mus musculus
ITLYGILPLGSAEVHERAPLVKSLLLAGPSGVGKKMLVHAICTETGANLFNLSALNIAGKYPGKTGLQMMIHLVFKVARQLQPSVVWIQDTEKTFYKKV

SEQ ID NO: 3692 - protein, 108 aa, Mus musculus; identical to SEQ ID NO: 3690

SEQ ID NO: 3693 - protein, 99 aa, Mus musculus; identical to SEQ ID NO: 3691

SEQ ID NO: 3694 - protein, 339 aa, Mus musculus
MEISDDVTNPEQLWKMKPKGNLEDDSYSTKDSGETSMLKRPGLSHLQHAVHVDAFDCPSELQHTQEFFPNWRLPVKVAAIISSLTFLYTLLREIIYPLVTSREQYFYKIPILVINKVLPMVAITLLALVYLPGELAAVVQLRNGTKYKKFPPWLDRWMLARKQFGLLSFFFAVLHAVYSLSYPMRRSYRYKLLNWAYKQVQQNKEDAWVEHDVWRMEIYVSLGIVGLAILALLAVTSIPSVSDSLTWREFHYIQSKLGIVSLLLGTVHALVFAWNKWVDVSQFVWYMPPTFMIAVFLPTLVLICKIALCLPCLRKKILKIRCGWEDVSKINRTEMASRL

SEQ ID NO: 3695 - protein, 600 aa, Mus musculus
MPEIRVTPLGAGQDVGRSCILVSISGKNVMLDCGMHMGYNDDRRFPDFSYITQSGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFITWTNQKIRKTFVQRNMFEFKHIKAFDRTFADNPGPMVVFATPGMLHAGQSLQIFRKWAGNEKNMVIMPGYCVQGTVGHKILSGQRKLEMEGRQMLEVKMQVEYMSFSAHADAKGIMQLVGQAEPESVLLVHGEAKKMEFLRQKIEQEFRVSCYMPANGETVTLPTSPSIPVGISLGLLKREMVQGLLPEAKKPRLLHGTLIMKDSNFRLVSSEQALKELGLAEHQLRFTCRVHLQDTRKEQETALRVYSHLKSTLKDHCVQHLPDGSVTVESILIQAAAHSEDPGTKVLLVSWTYQDEELGSFLTTLLKNGLPQAPS

SEQ ID NO: 3696 - protein, 1215 aa, Mus musculus
MFEVLVLKIEDPGCFWVIIKGCSHFLEQEVDYQKLNTAMNDFYNSMCQDVEMKPLMLEEGQVCVVYCQELKCWCRALIKSIISSADHYLAECFLVDFAKYIPVKSKNIRVAVESFMQLPYRAKKFRLYGTKPVTLHIDFCEDNAEIVPATKWDSAAIQYFQNLLRATTQVEAKLCAVEEDTFEVYLYATIKNEKVCVNDDLVAKNFAYYVSPMGNKNLNPLEKPRQSLNSVTCSSKLSPSLTLWPMLLQGKDYHRMENKALNYKDSLTDSPKMMLEKQQQSLPLKHTEKCTESSVYWPTKRGITIYADPDVPSVSGSSQRPNEKPLRLTEKKDCDEKNGCVKLLQFLNPDPLRADGTSDLHQLQKVKLGTLQPGVVLRNRIEPCLTLEKSPLSADLKKMALTCLNSDTEDMKVAMEEMIPPEALQRNKFPGPSHTASYSWPPIARGCDMVVISHCGNDPLLYLPPLLTILQMGGCYKSLPSRNGPLAVIVCPGWKKAQFIFELLGDYSMSSRPLHPVLLTIGLHKDEAKNMKLPRGCDVIVTTPHSLLRLLTYRSLLFLRLCHLVLDEVHMLFFEANEQMFAILDNFKKNVEVEERESAPHQIVAVGVHWNKHIDHLVREFMKDPCVVITALEEAALYGSVQQVVHLCLECEKTSTLLQVLDFVPSQAQKTLIFTCSVAETETVCKGSPAEQGDKKTKSVLLLTERNASHAVGILRYLERADAKIPSELYEFTAGVLEAKEDKKARRPLCPYLKAFGFCKDKRICPDRHHINPEMDIPRKLSNKTLPVFGHIRVIPFYISNATNYFGRIIDKHVDLYETLNAEMNEYFKESSNKTSAEKVENLGLYGLEEKTLFQRVQVLEVSQKEDTWGLGSILVKLIDEGRTKLITRDQLLLLPEKFHTLPPQAVEFIVCRVKPADSEIEWNPKVTRYIHHKIVGKMHDAKVVLALGNTLWIDPMVHVTKLSNLKTSIIDYNVRAEILSMGMGIDNSEHLEQLKKLYKEAKLPAFEDLPCQTSIPTTVEDTVCLQGTQQGDGGTERGAGSQEDSDNQKPGVLSEDIGSETISSAPQPHGRSFHPQIKWFQKDDVVILKIKIRNVKDYKCKFFTDRVIFSAWVGDKFYLADLELQGDIRKDDCKCIIKDDEPLITLAKEKQECWCGLLKQRNPNVAFDFDHWEECEEDSPFSKVVNSKNLSCKVAALAESSGSSSDTTDGSESE

SEQ ID NO: 3697 - protein, 21 aa, Mus musculus
YLLMVTVIFLPHISKATTWCK

SEQ ID NO: 3698 - protein, 84 aa, Mus musculus
YLLMVTVIFLPHISKATTWCKDKLMGQRESPAHDMEPFSIDLHAPLSKERVEAFSDGVYAIVATLLILDICEDNVPDPKDVQEK

SEQ ID NO: 3699 - protein, 218 aa, Mus musculus
MAAARLSHRMGRLLEKAPALGPWTRVYSTSPAFAEVLRLPQKQLTKVCFIGRSNVGKSSLIKALFSLAPDVEVRISKKPGHTKKMNFFKVGKHFTLVDMPGYGYRAPEDFVDMVETYLKERNNLKRTFLLVDSVVGITKLDNIAIEMCEEFALPYVMILTKIDKSSKGYLLKQVLQIQKFVNTQTQGCFPQLFPISAVTNSGVHLLKCFIADITGSLK

SEQ ID NO: 3700 - protein, 360 aa, Mus musculus
MALFSVRKARECWRFIRALHKGPAATLAPQKESGERVFSGIQPTGILHLGNYLGAIESWVNLQEEYDTVIYSIVDLHSITVPQDPTVLQQSILDMTAVLLACGINPEKSILFQQSKVSEHTQLSWILTCMVRLPRLQHLHQWKAKAAKQKHDGTVGLLTYPVLQAADILCYKSTHVPVGEDQVQHMELVQDLARSFNQKYGEFFPLPKSILTSMKKVKSLRDPSSKMSKSDPDKLATVRITDSPEEIVQKFRKAVTDFTSEVTYEPDSRAGVSNMVAIHAAVSGLSVEEVVRSSAGLDTARYKLLVADAVIEKFAPIRKEIEKLKMDKDHLRKVLLVGSAKAKELASPVFEEVKKLVGIL

SEQ ID NO: 3701 - protein, 1040 aa, Mus musculus
MADAFGDELFSVFEDDSTSAAGAKKDKEKEKWKGPPGSADKAGKRLDTKLQSESASGGKNKRDLDVEGTDEPIFGKKPRIEDSINEDLSLADLMPRVKVQSVETVEGCTHEVALPADEDYIPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFNNAIDCLSDEDKKLPQVEHVLPLLKRGIGIHHGGLLPILKETIEILFSEGLIKALFATETFAMGINMPARTVLFTNARKYDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEENVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISTVRLYIPKDLRPVDNRQSVLKSIQEVQRRFPDGVPLLDPIDDMGIQDQGLKKVIQKVEAFEHRMYSHPLHNDPNLETVYTLCERKAQIALDIKSAKRELKKARTVLQMDELKCRKRVLRRLGFATSSDVIEMKGRVACEISSADELLLTEMMFNGLFNDLSSEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 3702 - protein, 35 aa, Mus musculus
QDCEIKLWAVTITRVLGFELKYKSTLSGHCAPVLA

SEQ ID NO: 3703 - protein, 31 aa, Mus musculus
CEIKLWAVTITRVLGFELKYKSTLSGHCAPV

SEQ ID NO: 3704 - protein, 520 aa, Mus musculus
MAALKLLSSGLRLGASARSSRGALHKGCVCYFSVSTRHHTKFYTDPVEAVKDIPNGATLLVGGFGLCGIPENLIGALLKTGVKDLTAVSNNAGVDNFGLGLLLRSKQIKRMISSYVGENAEFERQFLSGELEVELTPQGTLAERIRAGGAGVPAFYTSTGYGTLVQEGGSPIKYNKDGSVAIASKPREVREFNGQHFILEEAITGDFALVKAWKADRAGNVIFRKSARNFNLPMCKAAGTTVVEVEEIVDIGSFAPEDIHIPKIYVHRLIKGEKYEKRIERLSLRKEGDGKGKSGKPGGDVRERIIKRAALEFEDGMYANLGIGIPLLASNFISPNMTVHLQSENGVLGLGPYPLKDEADADLINAGKETVTVLPGASFFSSDESFAMIRGGHVNLTMLGAMQVSKYGDLANWMIPGKMVKGMGGAMDLVSSSKTKVVVTMEHSAKGNAHKIMEKCTLPLTGKQCVNRIITEKGVFDVDKKNGLTLIELWEGLTVDDIKKSTGCDFAVSPNLMPMQQIST

SEQ ID NO: 3705 - protein, 186 aa, Mus musculus
MVKLAAKCILAGDPAVGKTALVQMFRSDGTHFQKNYTLTTGVDLVVKTVPVLDTNDSVELFIFDSAGKELFSEMLDKLWENPNVLCLVYDVTNEQSFISCTKWLEKVRSQTSGISLPGVLVGTKTDLAGRQTVDSAQAQVWALSQGLEFFETSVKEMDNYEAPFHCLAKQFYQLYREKVDIFHTLV

SEQ ID NO: 3706 - protein, 230 aa, Mus musculus
MAASQRPSWSESKVAGVVQEGNREAPQDIKMALYKHGQLIPSLGDAKFRSPIISEIIEKKFEHYRNDKTLNIHGTLVFGTSSSLSGIMANLVFRNSFKVKYEALKTYASLTTLPVLATIVSYKLFVTDALQSGDISKESCVLRSALIGMACGVSYPSALAFYKNGRLAVKYQTVPLPPKGRVMLHWLLLCQTGMKAMAIPLFFQIVMGAFTGLHHYNICEKPRARLVPDD

SEQ ID NO: 3707 - protein, 139 aa, Mus musculus
MAAGSWKATRLLLAILVALVAFSYQVKRKTFIRIEEVSALESSVKETLEYVTDEYNKKSEDLYNFRILRILKIMKQVTGHLEYHITVEMQRTTCLKTETSLCDIQKGELHKKIQCYFSVYAIPWVEVFKILKKNCTDIS

SEQ ID NO: 3708 - protein, 150 aa, Mus musculus
MDDNEVPFTEEDYRRRKHHPNFLDHINAEKIVLKFGKNAKKFATYVVASGLQYGAEGGILHTFFKMAWLGEVPALPVFGDGTNCIPAIHVVDLAGVIQNIIDHVPKLHYLVAVDEAVHTLEDLVKVCVLTPCRASLSSCTLWMLVTDFLC

SEQ ID NO: 3709 - protein, 74 aa, Mus musculus
NAHDLTKWDLFGNCYRLLKTGIEHGAMPEQIVVQALQCSHYSILWQLVKITDGSPSKEDLLVLRKTVKSFLAVC

SEQ ID NO: 3710 - protein, 68 aa, Mus musculus
TKWDLFGNCYRLLKTGIEHGAMPEQIVVQALQCSHYSILWQLVKITDGSPSKEDLLVLRKTVKSFLAV

SEQ ID NO: 3711 - protein, 121 aa, Mus musculus; identical to SEQ ID NO: 179

SEQ ID NO: 3712 - protein, 177 aa, Mus musculus; identical to SEQ ID NO: 2420

SEQ ID NO: 3713 - protein, 234 aa, Mus musculus
MAAAVPVPQFRPVTPLIFDLDGLILNTEDLYTDVFEEICNRYGKKYNWDVKSLVMGKKALETAQTIVEFLNLPISKEELLKESQEKLQMVLHTAGFMPGAEELIHHLKKHRLPFALATSSETVTFQTKTSRHTGFFGLFHHIVLGDDPEVKNGKPGMDIFLTCAKRFSPPPDPKDCLVFEDSPNGVEAAIHCGMQVVMVPHENLSADLTRKATLVLSSLHDFKPELFGLPAFTE

SEQ ID NO: 3714 - protein, 126 aa, Mus musculus
DPQLYKYLSQGHCARESPISDKNDWETVCGAFSVIGFTEADLENLFGIIASVLHLGNVCFKGDKQGCASVPDTHEIKWIAKLLGVCPAVLLEALTHRKIEAKTEEVICPLTVELSVYARDAMAKAV

SEQ ID NO: 3715 - protein, 107 aa, Mus musculus
LHLGNVCFKGDKQGCASVPDTHEIKWIAKLLGVCPAVLLEALTHRKIEAKTEEVICPLTVELSVYARDAMAKAVYGRTFTWLVNRINSSLVNKDFTQKTVIGLLDIY

SEQ ID NO: 3716 - protein, 428 aa, Mus musculus
MARSLCAGAWLRKPHYLQARLSYMRVKYLFFSWLVVFVGSWIIYVQYSTYTELCRGKDCKKIICDKYKTGVIDGPACNSLCVTETLYFGKCLSNKPSNQMYLGVWDNLPGVVKCQMEQALHLDFGTELEPRKEIVLFDKPTRGTTVQKFKEMVYSLFKAKLGDQGNLSELVNLILTVADGDRDGQVSLGEAKSAWALLQLNEFLLMVILQDKEHTPKLMGFCGDLYVMESVEYTSLYGISLPWVMELFIPSGFRRSMDQLFTPSWPRKAKIAIGLLEFVEDVFHGPYGNFLMCDTSAKNLGYNEKYDLKMVDMRKIVPETNLKELIKDRHCESDLDCVYGTDCRTSCDLSTMKCTSEVIQPNLAKACQLLKDYLLHGAPSEIREELEKQLYSCIALKVTANQMEMEHSLILNNLKTLLWKKISYTNDS

SEQ ID NO: 3717 - protein, 169 aa, Mus musculus
MAGSELRAELEQRLGALAIRTEVVEHPEVFTIEEMMPHIQHLKGAHSKNLFLKDKKKKNYWLVTVLHDRQINLNDLGKQLGVGSGNLRFADETAMLEKLKVGQGCATPLSLFCDDGDVKFVLDSAFLEGGHEKVYFHPMTNAATMGLSPEDFLIFVKATGHDPIILNFD

SEQ ID NO: 3718 - protein, 135 aa, Mus musculus
MMPHIQHLKGAHSKNLFLKDKKKKNYWLVTVLHDRQINLNDLGKQLGVGSGNLRFADETAMLEKLKVGQGCATPLSLFCDDGDVKFVLDSAFLEGGHEKVYFHPMTNAATMGLSPEDFLIFVKATGHDPIILNFD

SEQ ID NO: 3719 - protein, 165 aa, Mus musculus
MKRAFVTVGTTSFDELVARVVANDCVQILESLGYNHLVLQVGRGTVVPKPFRTESFTLDVYRYKDSLKEDLQQADLVISHAGAGSCLESLEKGKPLVVVVNEKLMNNHQFELAKQLHKEGHLFYCTCSTLPGLLQSMDLSTLKCYPPGQPEKFSAFLDKVVGLQK

SEQ ID NO: 3720 - protein, 337 aa, Mus musculus
MLGTINTTGMQGFNKSERCPRDTRMTQLLFPVLYTVVFLAGILLNTVALWVFVHIPSNSTFIVYLKNTLVADLIMALMLPFKILSDSHLAPWQLRGFVCTLSSVVFYETMYVGIMMLGLIAFDRFLKIIMPFRKTFVKKTAFAKTVSISVWSLMFFISLPNMILNKEATPSSVKKCASLKSPLGLWWHQVVSHTCQFIFWAVFILMLLFYAVITKKVYNSYRKFRSKDSRHKRLEVKVFIVMAVFFVCFAPLHFVRIPYTYSQTTNKTDCRLENQLFIAKEATLFLATTNICMDPLIYIILCKKFTQKVPCVRWGKARTAGSSEDHHSSQTDNITLA

SEQ ID NO: 3721 - protein, 72 aa, Mus musculus
VKKTAFAKTVSISVWSLMFFISLPNMILNKEATPSSVKKCASLKSPLGLWWHQVVSHTCQFIFWAVFILMLL

SEQ ID NO: 3722 - protein, 132 aa, Mus musculus
LKNTLVADLIMALMLPFKILSDSHLAPWQLRGFVCTLSSVVFYETMYVGIMMLGLIAFDRFLKIIMPFRKTFVKKTAFAKTVSISVWSLMFFISLPNMILNKEATPSSVKKCASLKSPLGLWWHQVVSHTCQ

SEQ ID NO: 3723 - protein, 132 aa, Mus musculus
DKHPLAFVIRMERIEGVSLLVKSTIMKLGLKKLFSGVFVKVTPQSVRMLRTVEPYVTWGFPNLKSVRELILKRGQAKINNKTVPLTDNTVIEEHLGRFGVICLEDLIHEIAFPGKHFQEVSSFLCPFLLSVA

SEQ ID NO: 3724 - protein, 115 aa, Mus musculus
MERIEGVSLLVKSTIMKLGLKKLFSGVFVKVTPQSVRMLRTVEPYVTWGFPNLKSVRELILKRGQAKINNKTVPLTDNTVIEEHLGRFGVICLEDLIHEIAFPGKHFQEVSSFLC

SEQ ID NO: 3725 - protein, 357 aa, Mus musculus
MAAVVAMDTQLMLGVGLIEKDSNGEALWVWCYPSTTASLRNLLLRKCCLTDENKLLHPFVFGQYRRTWFYVTTVEVPDSSVLKKVTHFSIVLTAKDFNPEKYAAFTRILCRIYLKYGSPVKMMESYIAVLTKGICQSEENGSFLSRDFDGRKAYLAGSIKDIVSQFGMETVILHTALMLKKRIVVYHPKIEAVQEFTRTLPALVWHRQDWTILHSYMHLHAEELEGLQMCTGYIAGFVELEVSNRPDLYDVFVNLADSEITIAPLAKEAMTMGKLHKEIGQLIVQSAEDPEKSDSQVIQDIALKTKEIFTHLAPFSEVSDDGGKVILNVEALKQQRFPPATENFLYHLAAAEQMLKV

SEQ ID NO: 3726 - protein, 50 aa, Mus musculus
MKLIIYLTILAGTALVTHSSVQKEDHAPYLAYLKSNFNPCVGVLIKASWV

SEQ ID NO: 3727 - protein, 128 aa, Mus musculus
MLWKSVLSVALIVLGIHDCSFKFLEIDKNEEEFAISVEHVVFHFNENQDDDFAYKFLRVRRSLRQKYTLKYLVDLEMGRTLCGKYDEDIDNCPLQEGPGERKVRCTYIVETEAWVTKFTILNSTCVQT

SEQ ID NO: 3728 - protein, 937 aa, Mus musculus
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTTTNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 3729 - protein, 951 aa, Mus musculus
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTTTNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 3730 - protein, 718 aa, Mus musculus
MAEYLRLPHSLAMIRLCNPPVNAISPTVITEVRNGLQKASLDHTVRAIVICGANDNFCAGADIHGFKSPTGLTLGSLVDEIQRYQKPVVAAIQGVALGGGLELALGCHYRIANAKARVGFPEVMLGILPGARGTQLLPRVVGVPVALDLITSGRHISTDEALKLGILDVVVKSDPVEEAIKFAQTVIGKPIEPRRILNKPVPSLPNMDSVFAEAIAKVRKQYPGRLAPETCVRSVQASVKHPYEVAIKEEAKLFMYLRGSGQARALQYAFFAEKSANKWSTPSGASWKTASAQPVSSVGVLGLGTMGRGIAISFARVGIPVVAVESDPKQLDTAKKIITSTLEKEASKSGQASAKPNLRFSSSTKELSSVDLVIEAVFEDMNLKKKVFAELSALCKPGAFLCTNTSALDVDDIASSTDRPQLVIGTHFFSPAHIMRLLEVIPSRYSSPTTIATVMSLSKRIGKIGVVVGNCYGFVGNRMLAPYYNQGYFLIEEGSKPEDVDGVLEEFGFRMGPFRVSDLAGLDVGWKVRKGQGLTGPSLPPGTPTRKRGNTRYSPIADMLCEAGRFGQKTGKGWYQYDKPLGRIHKPDPWLSEFLSQYRETHHIKQRSISKEEILERCLYSLINEAFRILEEGMAASPEHIDVIYLHGYGWPRHVGGPMYYAASVGLPTVLEKLQKYYRQNPDIPQLEPSDYLRRLVAQGSPPLKEWQSLAGPHSSKL

SEQ ID NO: 3731 - protein, 388 aa, Mus musculus
MKTLIAAYSGVLRGERRAEAARSENKNKGSALSREGSGRWGTGSSILSALQDIFSVTWLNRSKVEKQLQVISVLQWVLSFLVLGVACSVILMYTFCTDCWLIAVLYFTWLAFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLKNRKGFVKLALRHGADLVPTYSFGENEVYKQVIFEEGSWGRWVQKKFQKYIGFAPCIFHGRGLFSSDTWGLVPYSKPITTVVGEPITVPKLEHPTQKDIDLYHAMYMEALVKLFDNHKTKFGLPETEVLEVN

SEQ ID NO: 3732 - protein, 285 aa, Mus musculus
MFLLTPVLVAVVCILVVWVFKNADRNLEKKKEEAQVQPWVDEDLKDSTEDLQVEEDAEEWQEAEESVEHIPFSHTRYPEQEMRMRSQEFYELLNKRRSVRFISSEHVPMEVIENVIKAAGTAPSGAHTEPWTFVVVKDPDMKHKIREIIEEEEEINYMKRMGKRWVTDLKKLRTNWIKEYLDTAPVLILIFKQVHGFAANGKKKVHYYNEISVSIACGLLLAALQNAGLVTVTTTPLNCGPRLRVLLGRPSHEKLLVLLPVGYPSRDATVPDLKRKALDQIMVTV

SEQ ID NO: 3733 - protein, 120 aa, Danio rerio
KVHKDPGLKADSVVFIIVCCFIILENVLVLLTIWRTKKFHKPMYYFIGNLALSDLLAGVVYTANILLSGANTYKLTPTQWFFREGSMFVALAASVFSLLAIAIERHLTMLKMKLHNNGKT

SEQ ID NO: 3734 - protein, 24 aa, Danio rerio
VCCFIILENVLVLLTIWRTKKFHK

SEQ ID NO: 3735 - protein, 147 aa, Gobionotothen gibberifrons
MADFDMVLKCWGPVEADYTTHGSLVLTRLFTEHPETLKLFPKFAGIAHGDLAGDAGVSAHGATVLNKLGDLLKARGAHAALLKPLSSSHATKHKIPIINFKLIAEVIGKVMEEKAGLDAAGQTALRNVMAVIIADMEADYKELGFTE

SEQ ID NO: 3736 - protein, 147 aa, Pseudochaenichthys georgianus
MADFDMVLKCWGLVEADYATYGSLVLTRLFTEHPETLKLFPKFAGIAHGDLAGDAGVSAHGATVLNKLGDLLKARGGHAALLKPLSSSHATKHKIPIINFKLIAEVIGKVMEEKAGLDAAGQTALRNVMAVIIADMEADYKELGFTE

SEQ ID NO: 3737 - protein, 315 aa, Rana sylvatica
MPREDRATWKSNYFLKIIQLLDDYPKCFIVGADNVGSKQMQQIRMSLRGKAVVLMGKNTMMRKAIRGHLENNSALEKLLPHIKGNVGFVFTKEDLAEVRDMLLANKVPASARAGAIAPCDVTVPAQNTGLGPEKTSFFQALGITTKISRGTIEILSDVQLIKTGDKVGASEATLLNMLNISPFSFGLIIQQVYDNGSIYSPEVLDITEDALRARFLEGVRNIASVCLQIGYPTVASVPHSVVNGYKRVLALAVETDYSFPLADKVKAFLADPSAFVVAAPVAETAAAPAASAAPAKEEKEESEESDDDMGFGLFD

SEQ ID NO: 3738 - protein, 401 aa, Oryzias luzonensis
MALRVTRNRLASARAELGGKTCSVAGPTQKPRAALGEIGNVAVINKDVTKKNVKTEVAKKTKVPAKAEKIEQPKAAVVPVKPAPEVQVPAQPEPASPTPMETSGCEPADLCQAFSDVILNTAIRDVDADDYNNPLLCSEYVKDIYKYLRQLEVEQSVKPNYLEGQEVTGNMRALLIDWLVQVSLKFRLLQETMYMTVGIIDRFLQDHPVPKKQLQLVGVTAMFLASKYEEMYPPEISDFAYVTDKAYTTAQIRDMEMTILRVLKFQLGRPLPLQFLRRASKIYEVTAEQHTLAKYLLELSMVDYAMDHFPPSMVASAALALTLKVLDAGEWDVTLQHYMAYTADTLTPVMAHIAKNVVKVNNGQTKHMTIKGKYFTSKQMRIATIFQLKSSVVKDLATQIS

SEQ ID NO: 3739 - protein, 303 aa, Oryzias luzonensis
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLARAFGVPVRVYTHEVVTLWYRAPEVLLGSPRYSTPVDVWSTGTIFAELATKKPLFHGDSEIDQLFRIFRTLGTPNNDVWPDVESLPDYKNTFPKWKGGSLSSMVKNLDKNGLDLLAKMLIYNPPKRISAREAMTHPYFDDLDKSTLPAACINGV

SEQ ID NO: 3740 - protein, 401 aa, Oryzias javanicus
MALRVTRNRLASTRAEQGGKTCSVSGPTLKPRAALGEIGNVAANKDVTKKNVKMEAAKKTRITAKAEKIEQPKATVVPVKPEPKVQVPAQPEPASPTPMETSGCEPADLCQAFSDVILNTAIRDVDADDYDNPMLCSEYVKDIYKYLRQLEVEQSVKPNYLQGQEVTGNMRAILIDWLVQVNLKFRLLQETMYMTVGIIDRFLQDHPVPKKQLQLVGVTAMFLASKYEEMYPPEISDFAYVTDRAYTTAQIRDMEMTILRVLKFQLGRPLPLQFLRRASKIYEVTAEQHTLAKYLLELSIVDYDMAHFPPSTVASAALGLTLKVLDAGEWDVTLQHYMDYTAHTLTPVMAHIAKNVVKVNDGLTKHMAIKGKYSTSKQMRVATIAQLKSSLVKDLAKQLSQ

SEQ ID NO: 3741 - protein, 303 aa, Oryzias javanicus
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLARAFGVPVRVYTHEVVTLWYRAPEVLLGSPRYSTPVDVWSTGTIFAELATKKPLFHGDSEIDQLFRIFRTLGTPNNDVWPDVESLPDYKNTFPKWMEGSLSSMVKNLDKNGLDLLAKMLIYNPPKRISAREAMTHPYFDDLDKSTLPAACINGV

SEQ ID NO: 3742 - protein, 401 aa, Oryzias curvinotus
MALRVTRNRLASTRAELGGKTCSVAGPTQKPRAALGEIGNVAVINKDVTKKNVKTEVAKKTKIPAKAEKIEQPKAAVVPVKPAPEVQVPVQADPASPTPMETSGCEPADLCQAFSDVILNTAIRDVDADDYDNPMLCSEYVKDIYKYLRQLEVEQSVKPNYLEGQEVTGNMRAILIDWLVQVSLKFRLLPETMYMTVGIIDRFLQDHPVPKKQLQLVGVTAMFLASKYEEMYPPEISDFAFVTDRAYTTAQIRDMEMTVLRVLKFQLGRPLPLQFLRRASKIYEVTADQHTLAKYLLELSMVDYDMAHFPPSMVASAALALTLKVLDAGEWDVTLQHYMGYTAETLTPVMAHIAKNVVKVNNGQTKHMAIKGKYSTSKQMRIATISQLKSSAVKDLATQIS

SEQ ID NO: 3743 - protein, 303 aa, Oryzias curvinotus
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLSRAFGVPVRVYTHEVVTLWYRAPEVLLGSPRYSTPVDVWSTGTIFAELATKKPLFHGDSEIDQLFRIFRTLGTPNNDVWPDVESLPDYKSTFPKWKGGSLSSMVKNLDKNGLDLLAKMLIYNPPKRISAREAMTHPYFDDLDKSTLPAACINGV

SEQ ID NO: 3744 - protein, 303 aa, Oryzias latipes
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLARAFGVPVRVYTHEVVTLWYRAPEVLLGSPRYSTPVDVWSTGTIFAELATKKPLFHGDSEIDQLFRIFRTLGTPNNDVWPDVESLPDYKNTFPKWKEGSLSSMVKNLDKNGLDLLAKMLIYNPPKRISAREAMTHPYFDDLDKSTLPAACINGV

SEQ ID NO: 3745 - protein, 147 aa, Sarda chiliensis
MADFDAVLKFWGPVEADYTSHGGLVLTRLFKEHPETQKLFPKFTGIAQADMAGNAAISAHGATVLKKLGELLKAKGNHAAILKPMANSHATKHKIPINNFKLISEIIVKVMQEKAGMDAGGQQALRNVMAAVIADLEANYKELGFSG

SEQ ID NO: 3746 - protein, 147 aa, Thunnus alalunga
MADFDAVLKCWGPVEADYTTIGGLVLTRLFKEHPDTQKLFPKFAGIAQADLAGNAAISAHGATVLKKLGELLKAKGSHASILKPMANSHATKHKIPINNFKLISEVLVKVMQEKAGLDAGGQTALRNVMGIIIADLEANYKELGFTG

SEQ ID NO: 3747 - protein, 483 aa, Xenopus laevis
MAAKFLPRFWRSGSQAELLDFQNNNVVAEGKLDFEHGTLKGKSGRYGDDEEDVRRGHIEDLANHSLLNKLLRRTLVDSPHNVEVLQRDPTSPLFSVKSFEELHLKNELLRGIYAMGFNRPSKIQENALPMMLADPPQNLIAQSQSGTGKTAAFVLAMLSRVDANKKYPQCICLSPTFELALQTGKVVEEMGKFCAGIEVIYALRGNRPGKGSRLEAQIVIGTPGTVLDWCFKLRLITVENISVFVLDEADVMINVQGHSDHSVRVKRSMPKSCQMLLFSATFEDSVWAFAERIVPDPNIIKLKKEELTLKNIQQFYDQCENKEQKYSALCNLYGVITIAQAIVFCQTRKIASWLSQKLSDDGHQVALLSGELPVYDRADMIQRFREGREKVLVTTNVCARGIDVEQVSIVVNFDLPVNVDGSVDFETYLHRIGRTGRFGKKGIAVSLIENFFVYMLKEIEDHFNTKITKLNSMDMDEMGKIWK

SEQ ID NO: 3748 - protein, 127 aa, Mus musculus
MAAAAYEHLKLHITPEKFYVEACDDGADDVLIIDRVSTEVTLAVKKDVPPSAVTRPIFGILGTIHLVAGNYLVVITKKMKVGECFNHAVWRATDFDVLSYKKTMLHLTDIQLQDNKTFLAMLNHVLS

SEQ ID NO: 3749 - protein, 53 aa, Mus musculus
ILGTIHLVAGNYLVVITKKMKVGECFNHAVWRATDFDVLSYKKTMLHLTDIQL

SEQ ID NO: 3750 - protein, 988 aa, Rattus norvegicus
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTETVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDEEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRNQGSAQSDPERSQLQVESRPLQNGASITGTSVVTVSQITPIQTSLAYVKTSETLKQNNRDAMELKPNGGAEPKCLKVNSPIRMKNGNGKGWLRLKNNMGAHEEKKEEWNNVTKAESMGLLSEDPKGSDSENSVTKNPLRKTDSCDSGITKSDLRLDKAGEARSPLEHSPSQADAKHPFYPIPEQALQTTLQEVKHELKEDIQLLSCRMTALEKQVAEILKLLSEKSVPQTSSPKPQIPLQVPPQIPCQDIFSVSRPESPESDKDEINF

SEQ ID NO: 3751 - protein, 1249 aa, Rattus norvegicus
MDAKARNCLLQHKEALEKDIKTSYIMDHMISNGVLTVVEEEKVKSQATQYQRAAALIKMILNKDNYAYISFYNALLHEGYKDLAGLLHSGLPLVSSSSGKDTDGGNTSFVRTVLCEGGVPQRPVIFVTRKKLVSAIQQKLWKLNGEPGWVTIYGMAGCGKSVLAAEAVRDHALLEGCFSGGVHWVSIGKQDKSGLLMKLQNLCTRLGQEESFSQRLPLNIEEAKDRLRVLMLRKHPRSLLILDDVWDPWVLKAFDNQCQILLTTRDKSVTDSVMGPKYVIPVESGLGKEKGLEILSLFVNMKKEDLPVEAHSIIKECKGSPLVVSLVGALLRDFPNRWAYYLRQLQNKQFKRIRKSSSYDYEALDEAMSISVEMLREDIKDYYTDLSILQKDVKVPTKVLCVLWDLETEEVEDILQEFVNKSLLFCNRNGKSFCYYLHDLQVDFLTEKNRSQLQDLHRKMVTQFQRYHQPHTLSPGQEDCMYWYNFLAYHMASAGMHKELCALMFSLDWIKAKTELVGPAHLIHEFVEYRHILDEKDCAVCENFQEFLSLNGHLLGRQPFPNIVQLGLCEPETSEVYQQAKLQAKQEVDTGRLYLEWINKKTIKNLSRLVVRPHTDAVYHACFSQDGQRIASCGADKTLQVFKAETGEKLLDIKAHEDEVLCCAFSSDDSYIATCSVDKKVKIWDSGTGKLVHTYEEHSEQVNCCHFTNKSNHLLLATGSNDSFLKLWDLNQKECRNTMFGHTNSVTHCRFSPDDELLASCSADGTLKLWDVRSANEKKSINVKRFFLSSEDPPEDVEVIVKCCSWSADGDRIIVAAKNKVLLLDIHTSGLLTEIHTGHHSTIQYCDFSPYDHLAVIALSQYCVELWNIDSRVKVADCRGHLSWVHGVMFSPDGSSFLTASDDQTIRVWETRKVCKNSAIVLKQEIDVVFQENEMMVLAVDNIRGLQLIAGKTGQIDYLPEAQVSCCCLSPHLEYVAFGDEEGAIKIIELPNNRVFSSGIGHKKAVRHIQFTADGKTLISSSEDSVIQVWNWQTEEYVFLQAHQETVKDFRLLRDSRLLSWSFDGTVKVWNVITGRIERDFTCHQGTVLSCAISSDATKFSSTSADKTAKIWSFELPSPLHELKGHNSCVRCSAFSLDGILLATGDDNGEIRIWNVSDGQLLHLCAPISIEEGTATHGGWVTDVCFSPDRKMLVSAGGYLKWWNVVTGESSQTFYTNGTNLKKIHVSPDFRTYVTVDNLGILYILQVLE

SEQ ID NO: 3752 - protein, 120 aa, Rattus norvegicus
CIQPQLKSFALGIYTLAVRVLAGIPAPVYFGVLIDTSCLKWGFKKCGSRGSCRLYDSHAFRHIYLGLTTLLGTVSVFLSTAVLLVLKKKYVSKRSSFITAREKIVMSSSVKKETCAARDH

SEQ ID NO: 3753 - protein, 132 aa, Rattus norvegicus
CIQPQLKSFALGIYTLAVRVLAGIPAPVYFGVLIDTSCLKWGFKKCGSRGSCRLYDSHAFRHIYLGLTTLLGTVSVFLSTAVLLVLKKKYVSKRSSFITAREKIVMSSSVKKETCAARDHGLQPKYWPGKET

SEQ ID NO: 3754 - protein, 298 aa, Mus musculus
MKYLLDLILLLPLLIVFSIESLVKLFIPKKKKSVAGEIVLITGAGHGIGRLTAYEFAKLNTKLVLWDINKNGIEETAAKCRKLGAQAHPFVVDCSQREEIYSAAKKVKEEVGDVSILVNNAGVVYTADLFATQDPQIEKTFEVNVLAHFWTTKAFLPVMMKNNHGHIVTVASAAGHTVVPFLLAYCSSKFAAVGFHRALTDELAALGRTGVRTSCLCPNFINTGFIKNPSTNLGPTLEPEEVVEHLMHGILTEKQMIFVPSSIALLTVLERIVPERFLQVLKHRINVKFDAVVGYKDK

SEQ ID NO: 3755 - protein, 232 aa, Mus musculus
MKYLLDLILLLPLLIVFSIESLVKLFIPKKKKSVAGEIVLITGAGHGIGRLTAYEFAKLNTKLVLWDINKNGIEETAAKCRKLGAQAHPFVVDCSQREEIYSAAKKVKEEVGDVSILVNNAGVVYTADLFATQDPQIEKTFEVNVLAHFWTTKAFLPVMMKNNHGHIVTVASAAGHTVVPFLLAYCSSKFAAVGFHRALTDELAALGRTGVRTSCLCPNFINTGFIKNPSTK

SEQ ID NO: 3756 - protein, 88 aa, Rattus norvegicus
LYSVYPIIWAAGRGHADIVHLLLQNGAKVNCSDKYGTTPLVWAARKGHLECVKHLLAMGADVDQEGANSMTALIVAVKGGYTQSVKEI

SEQ ID NO: 3757 - protein, 111 aa, Rattus norvegicus
KTCCLPSFVIFLFIVGCIIAGITLLAIFRVDPKHLTVNAILISIASVVGLAFVLNCRTWWQVLDSLLNSQRKRLHSAASKLHKLKSEGFMKVLKCEVELMARMAKTIDSFT

SEQ ID NO: 3758 - protein, 88 aa, Rattus norvegicus
YSVYPIIWAAGRGHADIVHLLLQNGAKVNCSDKYGTTPLVWAARKGHLECVKHLLAMGADVDQEGANSMTALIVAVKGGYTQSVKEIL

SEQ ID NO: 3759 - protein, 111 aa, Rattus norvegicus; identical to SEQ ID NO: 3757

SEQ ID NO: 3760 - protein, 69 aa, Mus musculus; identical to SEQ ID NO: 1601

SEQ ID NO: 3761 - protein, 85 aa, Mus musculus; identical to SEQ ID NO: 1602

SEQ ID NO: 3762 - protein, 120 aa, Mus musculus
EVTSNFLGAMWLISITFLSIGYGDMVPHTYCGKGVCLLTGIMVKNAAANVLRETWLIYKHTRLVKKPDQGRVRKHQRKFLQAIHQLRSVKIEQGKVNDQANTLAELAKAQSIAYEVVSEL

SEQ ID NO: 3763 - protein, 31 aa, Mus musculus
YCGKGVCLLTGIMVKNAAANVLRETWLIYKH

SEQ ID NO: 3764 - protein, 149 aa, Mus musculus
SNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQGRVRKHQRKFLQAIHQLRSVKIEQGKVNDQANTLAELAKAQSIAYE

SEQ ID NO: 3765 - protein, 85 aa, Mus musculus; identical to SEQ ID NO: 1602

SEQ ID NO: 3766 - protein, 329 aa, Cavia porcellus
MVKAKSWTLKKHFQGKPTQSDFELKTVELPPLKNGEVLLEALFLSVDPYMRIASKRLKEGAVMMGQQVARVVESKNSAFPAGSIVLAQSGWTTHFISDGKGLEKLLTEWPDKLPLSLALGTIGMPGLTAYFGLLEVCGVKGGETVLVSAAAGAVGSVVGQIAKLKGCKVVGAAGSDEKIAYLKQIGFDAAFNYKTVNSLEEALKKASPDGYDCYFDNVGGEFLNTVLSQMKDFGKIAICGAISVYNRMDQLPPGPSPESIIYKQLRIEGFIVYRWQGDVREKALRDLMKWVLEGKIQYHEHVTKGFENMPAAFIEMLNGANLGKAVVTA

SEQ ID NO: 3767 - protein, 214 aa, Mus musculus
MSCRERTDSSCGCNGHEENRILKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAIGAQCYLECSALTQKGLKAVFDEAILTIFHPKKKKKGCLGCHGCCAII

SEQ ID NO: 3768 - protein, 204 aa, Mus musculus
MSCNGHEENRILKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAIGAQCYLECSALTQKGLKAVFDEAILTIFHPKKKKKGCLGCHGCCAII

SEQ ID NO: 3769 - protein, 115 aa, Mus musculus
QPQLKSFALGIYTLAVRVLAGIPAPVYFGVLIDTSCLKWGFKKCGSRGSCRLYDSHAFRHIYLGLTTLLGTVSVFLSMAVLFVLKKKYVSKHSSLITTREKIGMSSSIKKETCAA

SEQ ID NO: 3770 - protein, 93 aa, Mus musculus
VRVLAGIPAPVYFGVLIDTSCLKWGFKKCGSRGSCRLYDSHAFRHIYLGLTTLLGTVSVFLSMAVLFVLKKKYVSKHSSLITTREKIGMSSSI

SEQ ID NO: 3771 - protein, 67 aa, Rattus norvegicus
IMGTIHLVAGNYLVVITKKMKVGEFFNHVIWKATDFDVLSYKKTMLHLTDIQLQDNKTFLAMLNHVL

SEQ ID NO: 3772 - protein, 121 aa, Rattus norvegicus
EHLKLHITPEKFYVEACDDGADDVLIIDRVSTEVTLAVKKDVPPSAVTRPIYGIMGTIHLVAGNYLVVITKKMKVGEFFNHVIWKATDFDVLSYKKTMLHLTDIQLQDNKTFLAMLNHVLS

SEQ ID NO: 3773 - protein, 24 aa, Mus musculus
VHDLIFWRDVKKTGFVFGTTLIML

SEQ ID NO: 3774 - protein, 108 aa, Mus musculus
TLSSEAFHNYMNAAMVHVNKALKLIIRLFLVEDLVDSLKLAVFMWLMTYVGAVFNGITLLILAELLVFSVPIVYEKYKTQIDHYVGIARDQTKSIVEKIQAKLPGIAK

SEQ ID NO: 3775 - protein, 24 aa, Mus musculus
VHDLIFWRDVKKTGFVFGTTLIML

SEQ ID NO: 3776 - protein, 108 aa, Mus musculus; identical to SEQ ID NO: 3774

SEQ ID NO: 3777 - protein, 237 aa, Mus musculus
MAESSAATQSPSVSSSSSGAEPSALGGGGGSPGACPALGAKSCGSSCAVHDLIFWRDVKKTGFVFGTTLIMLLSLAAFSVISVVSYLILALLSVTISFRVYKSVIQAVQKSEEGHPFKAYLDVDITLSSEAFHNYMNAAMVHVNKALKLIIRLFLVEDLVDSLKLAVFMWLMTYVGAVFNGITLLILAELLVFSVPIVYEKYKTQIDHYVGIARDQTKSIVEKIQAKLPGIAKKKAE

SEQ ID NO: 3778 - protein, 256 aa, Mus musculus
MAESSAATQSPSVSSSSSGAEPSALGGGGGSPGACPALGAKSCGSSCADSFVSSSSSQPVSIFSTSQVHDLIFWRDVKKTGFVFGTTLIMLLSLAAFSVISVVSYLILALLSVTISFRVYKSVIQAVQKSEEGHPFKAYLDVDITLSSEAFHNYMNAAMVHVNKALKLIIRLFLVEDLVDSLKLAVFMWLMTYVGAVFNGITLLILAELLVFSVPIVYEKYKTQIDHYVGIARDQTKSIVEKIQAKLPGIAKKKAE

SEQ ID NO: 3779 - protein, 108 aa, Mus musculus; identical to SEQ ID NO: 3774

SEQ ID NO: 3780 - protein, 24 aa, Mus musculus
VHDLIFWRDVKKTGFVFGTTLIML

SEQ ID NO: 3781 - protein, 199 aa, Mus musculus
LLSVLVWMLMLLLAVPNIILTNQGVKEVTKIQCMELKNELGRKWHKASNYIFVSIFWVVFLLLIVFYTAITRKIFKSHLKSRKNSTSVKRKSSRNIFSIVLVFVVCFVPYHIARIPYTKSQTEGHYSCRTKETLLYAKEFTLLLSAANVCLDPIIYFFLCQPFREVLNKKLHMSLKVQNDLEVSKTKRENAIHESTDTL

SEQ ID NO: 3782 - protein, 174 aa, Mus musculus
VLVWMLMLLLAVPNIILTNQGVKEVTKIQCMELKNELGRKWHKASNYIFVSIFWVVFLLLIVFYTAITRKIFKSHLKSRKNSTSVKRKSSRNIFSIVLVFVVCFVPYHIARIPYTKSQTEGHYSCRTKETLLYAKEFTLLLSAANVCLDPIIYFFLCQPFREVLNKKLHMSLKV

SEQ ID NO: 3783 - protein, 173 aa, Mus musculus
MTAFFKTLRNHWKKTTAGLCLLTWGGHWLYGKHCDNLLRRAACQEAQVFGNQLIPPNAQVKKATVFLNPAACKGKARTLFEKNAAPILHLSGMDVTVVKTDYEGQAKKLLELMESTDVIIVAGGDGTLQEVVTGVLRRTDEATFSKIPIGFIPLGQTSSLSHTLFAESGNKVQ

SEQ ID NO: 3784 - protein, 178 aa, Bacillus sp.
MKLVVINGTPRKFGRTRVVAKYIADQFEGELYDLAIEELPLYNGEESQRDLEAVKKLKTLVKAADGVVLCTPEYHNAMSGALKNSLDYLSSSEFIHKPVALLAVAGGGKGGINALNSMHASLAGVYANAIPKQVVLDGLHVQDGELGEDAKPLIHDVVKELKAYMSVYKEVKKQLGVE

SEQ ID NO: 3785 - protein, 399 aa, Moorella thermoacetica
MSQPVAITDGIYWVGAVDWNIRYFHGPAFSTHRGTTYNAYLIVDDKTALVDTVYEPFKEELIAKLKQIKDPVKLDYLVVNHTESDHAGAFPAIMELCPDAHVLCTQRAFDSLKAHYSHIDFNYTIVKTGTSVSLGKRSLTFIEAPMLHWPDSMFTYVPEEALLLPNDAFGQHIATSVRFDDQVDAGLIMDEAAKYYANILMPFSNLITKKLDEIQKINLAIKTIAPSHGIIWRKDPGRIIEAYARWAEGQGKAKAVIAYDTMWLSTEKMAHALMDGLVAGGCEVKLFKLSVSDRNDVIKEILDARAVLVGSPTINNDILPVVSPLLDDLVGLRPKNKVGLAFGAYGWGGGAQKILEERLKAAKIELIAEPGPTVQWVPRGEDLQRCYELGRKIAARIAD

SEQ ID NO: 3786 - protein, 473 aa, Arabidopsis thaliana
MSLGYAEKLSFIEDVGQVGMAEFFDPSHLLQCKIEELAKLIQKSKHLVVFTGAGISTSCGIPDFRGPKGIWTLQREGKDLPKASLPFHRAMPSMTHMALVELERAGILKFVISQNVDGLHLRSGIPREKLSELHGDSFMEMCPSCGAEYLRDFEVETIGLKETSRKCSVEKCGAKLKDTVLDWEDALPPKEIDPAEKHCKKADLVLCLGTSLQITPACNLPLKCLKGGGKIVIVNLQKTPKDKKANVVIHGLVDKVVAGVMESLNMKIPPYVRIDLFQIILTQSISGDQRFINWTLRVASVHGLTSQLPFIKSIEVSFSDNHNYKDAVLDKQPFLMKRRTARNETFDIFFKVNYSDGCDCVSTQLSLPFEFKISTEEHVEIIDKEAVLQSLREKAVEESSCGQSGVVERRVVSEPRSEAVVYATVTSLRTYHSQQSLLANGDLKWKLEGSGTSRKRSRTGKRKSKALAEETKA

SEQ ID NO: 3787 - protein, 43 aa, Arabidopsis thaliana
AKTSLKHSTVVMIACALLVGLFVLQHRGTNKVAFLFAPIMILW

SEQ ID NO: 3788 - protein, 98 aa, Arabidopsis thaliana
LVKIPKGGWITLLLSLFFTFITYVWHYGSRKKYLCDQHNKVPMKSILSLGPSLGIIKVPGMGLIYTELASGVPATFKHFLTNLPAFYQVVVFVCCKTV

SEQ ID NO: 3789 - protein, 71 aa, Medicago truncatula
LHGQAEDVKHSGPTKLVLYFTGATNILYTFGGHAVTVEIMHAMWKPQKFKMIYLIATLYVMTLTLPSAAAV

SEQ ID NO: 3790 - protein, 31 aa, Medicago truncatula
VTVEIMHAMWKPQKFKMIYLIATLYVMTLTL

SEQ ID NO: 3791 - protein, 320 aa, Arabidopsis thaliana
MACQNNLVVKQIIDLYDQISKLKSLKPSKNVDTLFGQLVSTCLPTDTNIDVTNMCEEVKDMRANLIKLCGEAEGYLEQHFSTILGSLQEDQNPLDHLHIFPYYSNYLKLGKLEFDLLSQHSSHVPTKIAFVGSGPMPLTSIVLAKFHLPNTTFHNFDIDSHANTLASNLVSRDPDLSKRMIFHTTDVLNATEGLDQYDVVFLAALVGMDKESKVKAIEHLEKHMAPGAVLMLRSAHALRAFLYPIVDSSDLKGFQLLTIYHPTDDVVNSVVIARKLGGPTTPGVNGTRGCMFMPCNCSKIHAIMNNRGKKNMIEEFSAIE

SEQ ID NO: 3792 - protein, 200 aa, Arabidopsis thaliana
WSPEDGVGCIIISPTRELAAQTFGVLNKVGKFHKFSAGLLIGGREGVDVEKERVHEMNILVCAPGRLLQHMDETPNFECPQLQILILDEADRVLDSAFKGQLDPIISQLPKHRQTLLFSATQTKKVKDLARLSLRDPEYISVHAEAVTATPTSLMQTVMIVPVEKKLDMLWSFIKTHLNSRILVFLSTKKQVKFVHEAFN

SEQ ID NO: 3793 - protein, 57 aa, Arabidopsis thaliana
TSLMQTVMIVPVEKKLDMLWSFIKTHLNSRILVFLSTKKQVKFVHEAFNKLRPGIPL

SEQ ID NO: 3794 - protein, 806 aa, Arabidopsis thaliana
MSSSTLQASLFLRPPLHTSSFKLYPCLFSSSSLSFCPQSLSSFYRLSSVLHNSRFRPLPCSLRQDNVASDSDFIPKDSAFEVTDSAESNRLVSDTEVSELETNDRFVGGEETKSGGEEAEVSNGVTEGKEEDQKKSKFRIVVLMMALWAAIKRAIEKVMEWEWLSWWPFSRQEKRLEKLIAEADANPKDAALQGALLAELNKHIPEAVVQRFEQREHTVDSRGVAEYIRALVITNAISEYLPDEQTGKPSSLPALLQELKHRASGNMDESFVNPGISEKQPLHVTMVNPKVSNKSRFAQELVSTILFTVAVGLVWIMGAAALQKYIGSLGGIGTSGVGSSSSYSPKELNKEITPEKNVKTFKDVKGCDDAKQELEEVVEYLKNPSKFTRLGGKLPKGILLTGAPGTGKTLLAKAIAGEAGVPFFYRAGSEFEEMFVGVGARRVRSLFQAAKKKAPCIIFIDEIDAVGSTRKQWEGHTKKTLHQLLVEMDGFEQNEGIIVMAATNLPDILDPALTRPGRFDRHIVVPSPDVRGREEILELYLQGKPMSEDVDVKAIARGTPGFNGADLANLVNIAAIKAAVEGAEKLSSEQLEFAKDRIVMGTERKTMFVSEDSKKLTAYHESGHAIVALNTKGAHPIHKATIMPRGSALGMVTQLPSNDETSVSKRQLLARLDVCMGGRVAEELIFGLDHITTGASSDLSQATELAQYMVSSCGMSEAIGPVHIKERPSSDMQSRIDAEVVKLLREAYERVKSLLKRHEKQLHTLANALLEYETLTAEDIKRILLPKQEGEKFEEQQQEEGDLVLA

SEQ ID NO: 3795 - protein, 294 aa, Arabidopsis thaliana
MALTNNLWAFVFGILGNIISFVVFLAPVPTFVRICKKKSTEGFQSLPYVSALFSAMLWIYYAMQKDGTAFLLITINAFGCVIETIYIVLFVSYANKKTRISTLKVLGLLNFLGFAAIVLVCELLTKGSTREKVLGGICVGFSVSVFAAPLSIMRVVVRTRSVEFMPFSLSLFLTISAVTWLFYGLAIKDFYVALPNVLGAFLGAVQMILYIIFKYYKTPVAQKTDKSKDVSDHSIDIAKLTTVIPGAVLDSAVHQPPALHNVPETKIQLTEVKSQNMTDPKDQINKDVQKQSQV

SEQ ID NO: 3796 - protein, 1027 aa, Arabidopsis thaliana
MRLYVYILQAKDLPAKETFAKLHVGRHKSKTRVARDTSSPIWNEEFVFRISDVDEGDDVVVSILHHEQQDHQSIVSTGLIGKVRIPLTSVAAEENQTLLPTWFVIEKPSDGKFVNIECGKILLSLSLQGKWESTSGEKVLNDKQDIINLEGVKELEGSPKDLISSRDGKRRKHHDGKHIMKNIVNHIDKLFHKKEEISKRLHDESSVGQSVNSNYEDATDQCSSSATCTGFEEGLDLMQSSDSEREEMPENLTGGVLVDQKYLVSPCELNKFLFTPSSQFRKELAELQGLSDVQEGPWTMMQEDTPRLTRVVTYMRAATKMVKAVKATENQVYRKASGKQFAVFVSVSTPDVPYGNTFKIELLYKILPETEPTAGGEASRLIISWGIQFSQSTIMKGMIEGGARQGLKESFEQFSNLLAKTYKTLDPAVVLDKEQVIATVQSEPKTDLKSAFLYFWSSSVICAVLLSVYVVVHMLHCEPSKIQGFEFYGLDLPDSFGELFSSGILVLLLERVYIMTVHFVQARLHRGRDQGVKANGKGWILTIALIKGTNLASVEATELFDPYVVFTCNGKTRTSSVKLQAQDPQWNEVIEFDAMEEPPSVLDVEVFDFDGPFDQGASLGHAEINFLKHTADELADLSVALVGNHAQASQSKLQLRIFLENKNGVETMKDYLSKVEKEVGKKLNIRSPQKNSAFQKLFGLPHEEFLLKEYTCYLKRKLPVQGKLFLSARIVAFYSNVFGHKTKFYFLWEDIDDIQVLPPTFASLGSPLLLIILKKNRGLDAKHGAKSQDDEGRLSFYFQSFVSFDATSRTIMALWKTRTLSVDHRAQIVEEDQDVADPFLLPEAVTVVSDADALMMSKVYTCDLPCDVELVMKIFGGGELERKIMEKSGCLSYASTTWESKKPGVYERRLSYKYNHYVSVFGGGVTCAQQKSPAPNDEGWILNEIVALHDVPFGDHFRVHIRYEVKKAGVDCKTSKCEVYLKIRWLKTIKFEQRISKSIMEKFRNRFKVIFDLFQKESVANSSLTLL

SEQ ID NO: 3797 - protein, 497 aa, Arabidopsis thaliana
MEMMILISLCLTTFLTILLFFKSLLKRPNSNLPPSPWRLPVIGNLHQLSLHPHRALSSLSARHGPLMLLRFGRVPVLIVSSADVAHDVMKTHDLKFANRPITKSAHKISNGGRDLVFAPYGEYWRNVKSLCTIHLLSNKMVQSSEKRREEEITLLMETLEEASLSSSSVNLSKLITNMVSDIMGKVVLGKKYSGEEGTIDVKTITKSFLDAVGLSPVGEYIPSLAWIGKITGSDGKLEKITKQFGDFIEKVLQEHEDTTADKETPDFVDMLLTIQRDETAQCQLDKSDLKVIIFEMFLGSTTTTSAVIEWAMTRLMRNPECLKKLQDEIRSVSKMNSYVSGKEVENMNYLKAVIKEVLRLHPPLPLLVPRLLSEDVKLKGYDITAGTQVIINAWAIQRDTATWGSDAQEFRPERHFDSTWDFVGRNFKYIPFGAGRRLCPGIGLGSVMASVTLANLVKRFDWRVEDGPSGYDKPDLVEGAGIDVCRKFPLVVFPSSA

SEQ ID NO: 3798 - protein, 151 aa, Arabidopsis thaliana
VIVVTPTYVRTFQALHLTGVMHSLMLVPYDLVWIVVEAGGITNETASFIAKSGLKTIHLGFDQKMPNTWEDRHKLETKMRLHALRVVREKKLDGIVMFADDSNMHSMELFDEIQTVKWFGALSVGILAHSGNADELSSILKNEQGKNKEKP

SEQ ID NO: 3799 - protein, 444 aa, Arabidopsis thaliana
MPMFQPSKNGGFDGHILDLHSAVKDGVLGGGDGKFLVVVTDEKKKLDLKEMISELELPEIPSVFICPISLEPMQDPVTLCTGQTYERSNILKWFNIGHCTCPTTMQELWDDLVTPNKTLHQLIYTWFSQKYVLMKKRSEDVQGRAIEILGTLRKAKGKAKVHALSELKQVVMAHAIAKKTVVDEGGVFVISSLLSPFTSHAVGSEAIAILVNLELDSDSKAGLMQPARVSLMVDMLNDGSIETKINCARLIGRLVEEKGFRAELVSSHSLLVGLMRLVKDRRRRNGVSPALTLLKSVSVHKQVRNLLVRIGAVPQLVDVLPCLDVECLESALFVLDSLCLESEGRIALKDSVNTIPHTVRLLMKVSEKCTNYAISILWSVCKLASEECSSLAVEVGLAAKLLLVIQSGCDPALKQRSAELLKLCSLHYSDSMFISKCKLTRTIQ

SEQ ID NO: 3800 - protein, 200 aa, Arabidopsis thaliana
FDGHILDLHSAVKDGVLGGGDGKFLVVVTDEKKKLDLKEMISELELPEIPSVFICPISLEPMQDPVTLCTGQTYERSNILKWFNIGHCTCPTTMQELWDDLVTPNKTLHQLIYTWFSQKYVLMKKRSEDVQGRAIEILGTLRKAKGKAKVHALSELKQVVMAHAIAKKTVVDEGGVFVISSLLSPFTSHAVGSEAIAILV

SEQ ID NO: 3801 - protein, 194 aa, Arabidopsis thaliana
FQPSKNGGFDGHILDLHSAVKDGVLGGGDGKFLVVVTDEKKKLDLKEMISELELPEIPSVFICPISLEPMQDPVTLCTGQTYERSNILKWFNIGHCTCPTTMQELWDDLVTPNKTLHQLIYTWFSQKYVLMKKRSEDVQGRAIEILGTLRKAKGKAKVHALSELKQVVMAHAIAKKTVVDEGGVFVISSLLSPF

SEQ ID NO: 3802 - protein, 189 aa, Arabidopsis thaliana
TDALISQVLFYLPTKEAVSTSVLSSRWKSVWLLIPDLDLNSSAFPSNNAFVGFIDKFIDFSKIENSCLHKLKLSIRKEHENDNKSCVTRWIGFVATHKLKHLDVECLLWKKKCLEVMPLTLYITQTLFYLRLHRVLLGNVESISLPCLKTMHLEQNVYANETCLEFFISSCPVLEDLSIVRKVDDNVKV

SEQ ID NO: 3803 - protein, 146 aa, Arabidopsis thaliana
VGFIDKFIDFSKIENSCLHKLKLSIRKEHENDNKSCVTRWIGFVATHKLKHLDVECLLWKKKCLEVMPLTLYITQTLFYLRLHRVLLGNVESISLPCLKTMHLEQNVYANETCLEFFISSCPVLEDLSIVRKVDDNVKVLRVLSQT

SEQ ID NO: 3804 - protein, 388 aa, Arabidopsis thaliana
MTIMSDLPRDLLAEILSRVPLTSLRAVRLTCKKWNDLSKDRSFLKKQIVETKKKQLESKEIEVIMMRNFRVYLTSIDIHNNVDPSFTPKGTLISLSDDANHHQVDNVSRVFHCDGLLLCITKDLHYRLVVWNPYFGQTRWIQPRNSYHRKDNYALGYDEKKNHKILRLKDNYYAPRERICEFELYSFESNSWKVVLDVSPDWYIPSYNRGLSLKGNTYWYATEKHVNVDFLICFDFTTEKFGPRLPLPFNATESPTYEDVVTLSSVGEEQLAVLFQSEYTLMMEIWVTSKVESTEVLWNKLFLEVDLIAISSHFQFLAEAGSFFIDQKKNVVVVFDKDMDEATDRDMAYVVGKNGYFKKVDIGEEAYTSCFPLVCSYVPSSEQIRQLT

SEQ ID NO: 3805 - protein, 89 aa, Arabidopsis thaliana
FLKKQIVETKKKQLESKEIEVIMMRNFRVYLTSIDIHNNVDPSFTPKGTLISLSDDANHHQVDNVSRVFHCDGLLLCITKDLHYRLVVW

SEQ ID NO: 3806 - protein, 95 aa, Arabidopsis thaliana
LGICGGLFTYKFIQYKNKAAYGVMGYCVCVAKGGAETLKFNMALILLPVCRNTITWLRNKTKLGTVVPFDDSLNFHKVIASGIVVGVLLHAGAHL

SEQ ID NO: 3807 - protein, 103 aa, Arabidopsis thaliana
IQYKNKAAYGVMGYCVCVAKGGAETLKFNMALILLPVCRNTITWLRNKTKLGTVVPFDDSLNFHKVIASGIVVGVLLHAGAHLTCDFPRLIAADEDTYEPMEK

SEQ ID NO: 3808 - protein, 64 aa, Arabidopsis thaliana
VQVSLFSALHEKEKKKKGGMTRIQFFLIVLVTSFAYYILPGYLFTMITSISWICWLGPKSVLVH

SEQ ID NO: 3809 - protein, 71 aa, Arabidopsis thaliana
QIAVVPLGHLMAKVLPTRMFLEGSKWEFSMNPGPFNVKEHVLITIFANSGAGTVYATHILSAIKLYYKRSL

SEQ ID NO: 3810 - protein, 75 aa, Arabidopsis thaliana
EFDSGVDDLVSTKKYIVWSTHMNTHVLPEFLVCIKAPFNLTRSPKRLRSPWMAFPVLIKALSKFLPPSQILVIQK

SEQ ID NO: 3811 - protein, 68 aa, Arabidopsis thaliana
VDDLVSTKKYIVWSTHMNTHVLPEFLVCIKAPFNLTRSPKRLRSPWMAFPVLIKALSKFLPPSQILVI

SEQ ID NO: 3812 - protein, 253 aa, Arabidopsis thaliana
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 3813 - protein, 363 aa, Arabidopsis thaliana
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFDLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 3814 - protein, 295 aa, Arabidopsis thaliana
MGKLATLNGILKDEASQMKLNVVHLCSSVNAKTIDLALLKATSHTSNNPPSDKYVTFLQSTIDTCYGPDTVDAILHRLRVTTDVCVAAKCLILLHKMVKSESGYNGEDSLRNNINHRTLIYTQGGSNLKLNDLNVNSSRFTRELTPWVQWYKQYLDCYLSIAEVLGITPNIKEKNEDKRLETQRVSSYPMDCILKQIDFLVELFEHISDRPKAPQSKLNKIVIEMTELMVQDYFSAIRLMRIRFEELNVRVAKPNELVPVLEKLENCKEGLSEFSWRSKYLIADFWYLVSKLKDM

SEQ ID NO: 3815 - protein, 596 aa, Arabidopsis thaliana
MVNLLSANREALIAQSICATVLKGNWKNILKHKVDSGLLKSAITTQVISELSLFSGYGGPSLSWSFFIWTDSLPSSKHSLQSSWKMILILTKHKHFKTAHQLLDKLAQRELLSSPLVLRSLVGGVSEDPEDVSHVFSWLMIYYAKAGMINDSIVVFEQIRSCGLKPHLQACTVLLNSLVKQRLTDTVWKIFKKMVKLGVVANIHVYNVLVHACSKSGDPEKAEKLLSEMEEKGVFPDIFTYNTLISVYCKKSMHFEALSVQDRMERSGVAPNIVTYNSFIHGFSREGRMREATRLFREIKDDVTANHVTYTTLIDGYCRMNDIDEALRLREVMESRGFSPGVVTYNSILRKLCEDGRIREANRLLTEMSGKKIEPDNITCNTLINAYCKIEDMVSAVKVKKKMIESGLKLDMYSYKALIHGFCKVLELENAKEELFSMIEKGFSPGYATYSWLVDGFYNQNKQDEITKLLEEFEKRGLCADVALYRGLIRRICKLEQVDYAKVLFESMEKKGLVGDSVIFTTMAYAYWRTGKVTEASALFDVMYNRRLMVNLKLYKSISASYAGDNDVLRFFWSHVGDRCLISKSILREMNRSEVL

SEQ ID NO: 3816 - protein, 102 aa, Arabidopsis thaliana
AKAGMINDSIVVFEQIRSCGLKPHLQACTVLLNSLVKQRLTDTVWKIFKKMVKLGVVANIHVYNVLVHACSKSGDPEKAEKLLSEMEEKGVFPDIFTYNTLI

SEQ ID NO: 3817 - protein, 93 aa, Arabidopsis thaliana
IVVFEQIRSCGLKPHLQACTVLLNSLVKQRLTDTVWKIFKKMVKLGVVANIHVYNVLVHACSKSGDPEKAEKLLSEMEEKGVFPDIFTYNTLI

SEQ ID NO: 3818 - protein, 1372 aa, Arabidopsis thaliana
MTESEQIVYISCIEEVRYSFVSHLSKALQRKGVNDVFIDSDDSLSNESQSMVERARVSVMILPGNRTVSLDKLVKVLDCQKNKDQVVVPVLYGVRSSETEWLSALDSKGFSSVHHSRKECSDSQLVKETVRDVYEKLFYMERIGIYSKLLEIEKMINKQPLDIRCVGIWGMPGIGKTTLAKAVFDQMSGEFDAHCFIEDYTKAIQEKGVYCLLEEQFLKENAGASGTVTKLSLLRDRLNNKRVLVVLDDVRSPLVVESFLGGFDWFGPKSLIIITSKDKSVFRLCRVNQIYEVQGLNEKEALQLFSLCASIDDMAEQNLHEVSMKVIKYANGHPLALNLYGRELMGKKRPPEMEIAFLKLKECPPAIFVDAIKSSYDTLNDREKNIFLDIACFFQGENVDYVMQLLEGCGFFPHVGIDVLVEKSLVTISENRVRMHNLIQDVGRQIINRETRQTKRRSRLWEPCSIKYLLEDKEQNENEEQKTTFERAQVPEEIEGMFLDTSNLSFDIKHVAFDNMLNLRLFKIYSSNPEVHHVNNFLKGSLSSLPNVLRLLHWENYPLQFLPQNFDPIHLVEINMPYSQLKKLWGGTKDLEMLKTIRLCHSQQLVDIDDLLKAQNLEVVDLQGCTRLQSFPATGQLLHLRVVNLSGCTEIKSFPEIPPNIETLNLQGTGIIELPLSIVKPNYRELLNLLAEIPGLSGVSNLEQSDLKPLTSLMKISTSYQNPGKLSCLELNDCSRLRSLPNMVNLELLKALDLSGCSELETIQGFPRNLKELYLVGTAVRQVPQLPQSLEFFNAHGCVSLKSIRLDFKKLPVHYTFSNCFDLSPQVVNDFLVQAMANVIAKHIPRERHVTGFSQKTVQRSSRDSQQELNKTLAFSFCAPSHANQNSKLDLQPGSSSMTRLDPSWRNTLVGFAMLVQVAFSEGYCDDTDFGISCVCKWKNKEGHSHRREINLHCWALGKAVERDHTFVFFDVNMRPDTDEGNDPDIWADLVVFEFFPVNKQRKPLNDSCTVTRCGVRLITAVNCNTSIENISPVLSLDPMEVSGNEDEEVLRVRYAGLQEIYKALFLYIAGLFNDEDVGLVAPLIANIIDMDVSYGLKVLAYRSLIRVSSNGEIVMHYLLRQMGKEILHTESKKTDKLVDNIQSSMIATKEIEITRSKSRRKNNKEKRVVCVVDRGSRSSDLWVWRKYGQKPIKSSPYPRSYYRCASSKGCFARKQVERSRTDPNVSVITYISEHNHPFPTLRNTLAGSTRSSSSKCSDVTTSASSTVSQDKEGPDKSHLPSSPASPPYAAMVVKEEDMEQWDNMEFDVDVEEDTFIPELFPEDTFADMDKLEENSQTMFLSRRSSGGNMEAQGKNSSDDREVNLPSKILNR

SEQ ID NO: 3819 - protein, 55 aa, Arabidopsis thaliana
ALKVIPVDSYSPELKMKATECLICLGDFVEGETVRVLPKCNHGFHVKCIDTWLLS

SEQ ID NO: 3820 - protein, 50 aa, Arabidopsis thaliana
IPVDSYSPELKMKATECLICLGDFVEGETVRVLPKCNHGFHVKCIDTWLL

SEQ ID NO: 3821 - protein, 529 aa, Arabidopsis thaliana
MLDSTPMLAFIIGLLLLALTMKRKEKKKTMLISPTRNLSLPPGPKSWPLIGNLPEILGRNKPVFRWIHSLMKELNTDIACIRLANTHVIPVTSPRIAREILKKQDSVFATRPLTMGTEYCSRGYLTVAVEPQGEQWKKMRRVVASHVTSKKSFQMMLQKRTEEADNLVRYINNRSVKNRGNAFVVIDLRLAVRQYSGNVARKMMFGIRHFGKGSEDGSGPGLEEIEHVESLFTVLTHLYAFALSDYVPWLRFLDLEGHEKVVSNAMRNVSKYNDPFVDERLMQWRNGKMKEPQDFLDMFIIAKDTDGKPTLSDEEIKAQVTELMLATVDNPSNAAEWGMAEMINEPSIMQKAVEEIDRVVGKDRLVIESDLPNLNYVKACVKEAFRLHPVAPFNLPHMSTTDTVVDGYFIPKGSHVLISRMGIGRNPSVWDKPHKFDPERHLSTNTCVDLNESDLNIISFSAGRRGCMGVDIGSAMTYMLLARLIQGFTWLPVPGKNKIDISESKNDLFMAKPLYAVATPRLAPHVYPT

SEQ ID NO: 3822 - protein, 487 aa, Arabidopsis thaliana
MMSTTVRLNRFTYLTSTAKLTRYFCSHHLVDRSETALHEVIRIVSSPVGGLDDLEENLNQVSVSPSSNLVTQVIESCKNETSPRRLLRFFSWSCKSLGSSLHDKEFNYVLRVLAEKKDHTAMQILLSDLRKENRAMDKQTFSIVAETLVKVGKEEDAIGIFKILDKFSCPQDGFTVTAIISALCSRGHVKRALGVMHHHKDVISGNELSVYRSLLFGWSVQRNVKEARRVIQDMKSAGITPDLFCFNSLLTCLCERNVNRNPSGLVPEALNIMLEMRSYKIQPTSMSYNILLSCLGRTRRVRESCQILEQMKRSGCDPDTGSYYFVVRVLYLTGRFGKGNQIVDEMIERGFRPERKFYYDLIGVLCGVERVNFALQLFEKMKRSSVGGYGQVYDLLIPKLCKGGNFEKGRELWEEALSIDVTLSCSISLLDPSVTEVFKPMKMKEEAAMVDRRALNLKIHARMNKTKPKLKLKPKRRSKTKKKNLQH

SEQ ID NO: 3823 - protein, 499 aa, Arabidopsis thaliana
MINYSSCSYLLKLCRTLKHLHQFHAQFITSGRISNDFKQNSVFANVLFAITSISPSASASKEVVSYATSVFRFITNPSTFCFNTIIRICTLHEPSSLSSKRFFVEMRRRSVPPDFHTFPFVFKACAAKKNGDLTLVKTLHCQALRFGLLSDLFTLNTLIRVYSLIAPIDSALQLFDENPQRDVVTYNVLIDGLVKAREIVRARELFDSMPLRDLVSWNSLISGYAQMNHCREAIKLFDEMVALGLKPDNVAIVSTLSACAQSGDWQKGKAIHDYTKRKRLFIDSFLATGLVDFYAKCGFIDTAMEIFELCSDKTLFTWNAMITGLAMHGNGELTVDYFRKMVSSGIKPDGVTFISVLVGCSHSGLVDEARNLFDQMRSLYDVNREMKHYGCMADLLGRAGLIEEAAEMIEQMPKDGGNREKLLAWSGLLGGCRIHGNIEIAEKAANRVKALSPEDGGVYKVMVEMYANAERWEEVVKVREIIDRDKKVKKNVGFSKVLS

SEQ ID NO: 3824 - protein, 54 aa, Arabidopsis thaliana
VKEVPKHQTKFNLDIASMLGPLFFTWVVLLLFPVILTSLVYEKQERLRIIMKMH

SEQ ID NO: 3825 - protein, 55 aa, Arabidopsis thaliana
VKEVPKHQTKFNLDIASMLGPLFFTWVVLLLFPVILTSLVYEKQERLRIIMKMHG

SEQ ID NO: 3826 - protein, 110 aa, Arabidopsis thaliana
IPKPEIVIFNTLIHGFVTHGRLDDAKAVLSDMVTSYGIVPDVCTYNSLIYGYWKEGLVGLALEVLHDMRNKGCKPNVYSYTILVDGFCKLGKIDEAYNVLNEMSADGLKP

SEQ ID NO: 3827 - protein, 147 aa, Arabidopsis thaliana
LASVSPVLTNIIEKPRKIHGGSSKKVIKILGVPCDAVSVFVRFLYSPSVTENEMEKYGIHLLALSHVYMVTQLKQRCTKGVGERVTAENVVDILQLARLCDAPDLCLKCMRFIHYKFKTVEQTEGWKFLQEHDPFLELDILQFIDDA

SEQ ID NO: 3828 - protein, 134 aa, Arabidopsis thaliana
LTNIIEKPRKIHGGSSKKVIKILGVPCDAVSVFVRFLYSPSVTENEMEKYGIHLLALSHVYMVTQLKQRCTKGVGERVTAENVVDILQLARLCDAPDLCLKCMRFIHYKFKTVEQTEGWKFLQEHDPFLELDIL

SEQ ID NO: 3829 - protein, 452 aa, Arabidopsis thaliana
MALKVIKISRVSPATASVDPLIVPLSFFDLQWLKLNPTEQVFFYKLTESSSSRDVFYSSILPKLERSLSLILTHFRLFTGHLKWDSQDPKPHLVVLSGDTLSLTVAETDADFSRISGRGLRPELELRPLIPELPIYSDSGAVVSLQVTLFPKQGFCIGTTAHHVVLDGKTAEKFNKAWAHTCKHGTIPKILPTVLDRSVVNVPAGLEQKMLELLPYLTEDDKENGRTLKLPPVKEINAKDNVLRITIEISPENIEKLKERAKKESTRAELHLSTFVVTFAHVWTCMVKARSGDPNRPVRFMYAADFRNRLEPPVPVTYFGTCVLAMDFYKYKAKEFMGEDGFVNTVEILSDSVKRLASQGVESTWKVYEEGTKTMKWGTQLLVVNGSNQIGMYETDFGWGRPIHTETMSIYKNDEFSMSKRRDGIGGVEIGISLKKLEMDTFLSLFYKWIGN

SEQ ID NO: 3830 - protein, 162 aa, Oryza sativa
MAPVAVGDTLPDGQLGWFDGEDKLQQVSVHGLAAGKKVVLFGVPGAFTPTCSNQHVPGFINQAEQLKAKGVDDILLVSVNDPFVMKAWAKSYPENKHVKFLADGLGTYTKALGLELDLSEKGLGIRSRRFALLADNLKVTVANIEEGGQFTISGAEEILKAL

SEQ ID NO: 3831 - protein, 393 aa, Ruta graveolens
MAAVTVEEIRKAQRADGPATVLAIGTATPANYVTQADYPDYYFRITKSEHMTDLKEKFKRMCDKSMIRKRYMHLTEEILKENPNMCAYMAPSLDARQDIVVVEVPKLGKEAAAKAIKEWGQPKSKITHLIFCTTSGVDMPGCDYQLTKLLGLRPSVKRFMMYQQGCFAGGTVLRLAKDLAENNRGARVLVVCSEITAVTFRGPVDTHLDSLVGQALFGDGAAAVIVGADPDESIERPLYQLVSAAQTILPDSDGAIDGHLREVGLTFHLLKDVPGLISKNIEKSLKEAFGPIGISDWNSIFWIAHPGGPAILDQVEEKLELKEEKLRATRHVLSEYGNMSSACVLFILDEMRKKCAEEGMATTGEGLEWGVLFGFGPGLTVETVVLRSVPIKA

SEQ ID NO: 3832 - protein, 391 aa, Ruta graveolens
MESLKEMRKAQKSEGPAAILAIGTATPDNVYIQADYPDYYFKITKSEHMTELKDKFKTLCEKSMIRKRHMCFSQEFLKANPEVCKHMGKSLNARQDIAVVETPRIGKEAAVKAIKEWGHPKSSITHLIFCTSAGVDMPGADYQLTRMLGLNPSVKRMMIYQQGCYAGGTVLRLAKDLAENNKGSRVLVVCSELTAPTFRGPSPDAVDSLVGQALFADGAAALVVGADPDTSVERALYYIVSASQMLLPDSDGAIEGHIREEGLTVHLKKDVPALFSANIDTPLVEAFRPLGISDWNSIFWIAHPGGPAILDQIEVKLGLKEDKLRASKHVMSEYGNMSSSCVLFVLDEMRNKSLQDGKSTTGEGLDWGVLFGFGPGLTVETVVLRSVPVEA

SEQ ID NO: 3833 - protein, 391 aa, Ruta graveolens
MESLKEMRKAQMSEGPAAILAIGTATPNNVYMQADYPDYYFRMTKSEHMTELKDKFRTLCEKSMIRKRHMCFSEEFLKANPEVSKHMGKSLNARQDIAVVETPRLGNEAAVKAIKEWGQPKSSITHLIFCSSAGVDMPGADYQLTRILGLNPSVKRMMVYQQGCYAGGTVLRLAKDLAENNKGSRVLVVCSELTAPTFRGPSPDAVDSLVGQALFADGAAALVVGADPDSSIERALYYLVSASQMLLPDSDGAIEGHIREEGLTVHLKKDVPALFSANIDTPLVEAFKPLGISDWNSIFWIAHPGGPAILDQIEEKLGLKEDKLRASKHVMSEYGNMSSSCVLFVLDEMRSRSLQDGKSTTGEGLDWGVLFGFGPGLTVETVVLRSVPIEA

SEQ ID NO: 3834 - protein, 390 aa, Hypericum androsaemum
MVTVEEVRKAQRAEGPATVMAIGTAVPPNCVDQATYPDYYFRITNSEHKAELKEKFQRMCDKSQIKKRYMYLNEEVLKENPNMCAYMAPSLDARQDIVVVEVPKLGKEAAVKAIKEWGQPKSKITHLVFCTTSGVDMPGADYQLTKLLGLRPSVKRLMMYQQGCFAGGTVLRLAKDLAENNKGARVLVVCSEITAVTFRGPTDTHLDSLVGQALFGDGAAAIIIGSDPIPEVEKPLFELVSAAQTILPDSEGAIDGHLREVGLTFHLLKDVPGLISKNVEKSLTEAFKPLGISDWNSLFWIAHPGGPAILDQVEAKLSLKPEKLRATRHVLSEYGNMSSACVLFILDEMRRKSKEDGLKTTGEGIEWGVLFGFGPGLTVETVVLHSVAIN

SEQ ID NO: 3835 - protein, 63 aa, Arabidopsis thaliana
VVPAHMFRKVISITKSHCKLGLTATLVREDEKITDLNFLIGPKLYEANWLDLVKGGFIANVQC

SEQ ID NO: 3836 - protein, 65 aa, Arabidopsis thaliana
VVPAHMFRKVISITKSHCKLGLTATLVREDEKITDLNFLIGPKLYEANWLDLVKGGFIANVQCAE

SEQ ID NO: 3837 - protein, 227 aa, Arabidopsis thaliana
MAQNDTVKLIGSWSSPYSLRARVALHLKSVKYEYLDEPDVLKEKSELLLKSNPIHKKVPVLLHGDLSISESLNVVQYVDEAWPSVPSILPSDAYDRASARFWAQYIDDKCFAAVDAVVGAKDDEGKMAAVGKLMECLAILEETFQKSSKGLGFFGGETIGYLDIACSALLGPISVIEAFSGVKFLRQETTPGLIKWAERFRAHEAVKPYMPTVEEVVAFAKQKFNVQ

SEQ ID NO: 3838 - protein, 787 aa, Arabidopsis thaliana
MASFIDLFAGDITTQLLKLLALVANTVYSCKGIAERLITMIRDVQPTIREIQYSGAELSNHHQTQLGVFYEILEKARKLCEKVLRCNRWNLKHVYHANKMKDLEKQISRFLNSQILLFVLAEVCHLRVNGDRIERNMDRLLTERNDSLSFPETMMEIETVSDPEIQTVLELGKKKVKEMMFKFTDTHLFGISGMSGSGKTTLAIELSKDDDVRGLFKNKVLFLTVSRSPNFENLESCIREFLYDGVHQRKLVILDDVWTRESLDRLMSKIRGSTTLVVSRSKLADPRTTYNVELLKKDEAMSLLCLCAFEQKSPPSPFNKYLVKQVVDECKGLPLSLKVLGASLKNKPERYWEGVVKRLLRGEAADETHESRVFAHMEESLENLDPKIRDCFLDMGAFPEDKKIPLDLLTSVWVERHDIDEETAFSFVLRLADKNLLTIVNNPRFGDVHIGYYDVFVTQHDVLRDLALHMSNRVDVNRRERLLMPKTEPVLPREWEKNKDEPFDAKIVSLHTGEMDEMNWFDMDLPKAEVLILNFSSDNYVLPPFIGKMSRLRVLVIINNGMSPARLHGFSIFANLAKLRSLWLKRVHVPELTSCTIPLKNLHKIHLIFCKVKNSFVQTSFDISKIFPSLSDLTIDHCDDLLELKSIFGITSLNSLSITNCPRILELPKNLSNVQSLERLRLYACPELISLPVEVCELPCLKYVDISQCVSLVSLPEKFGKLGSLEKIDMRECSLLGLPSSVAALVSLRHVICDEETSSMWEMVKKVVPELCIEVAKKCFTVDWLDD

SEQ ID NO: 3839 - protein, 577 aa, Artemisia annua
MSTLPISSVSFSSSTSPLVVDDKVSTKPDVIRHTMNFNASIWGDQFLTYDEPEDLVMKKQLVEELKEEVKKELITIKGSNEPMQHVKLIELIDAVQRLGIAYHFEEEIEEALQHIHVTYGEQWVDKENLQSISLWFRLLRQQGFNVSSGVFKDFMDEKGKFKESLCNDAQGILALYEAAFMRVEDETILDNALEFTKVHLDIIAKDPSCDSSLRTQIHQALKQPLRRRLARIEALHYMPIYQQETSHNEDLLKLAKLDFSVLQSMHKKELSHICKWWKDLDLQNKLPYVRDRVVEGYFWILSIYYEPQHARTRMFLMKTCMWLVVLDDTFDNYGTYEELEIFTQAVERWSISCLDMLPEYMKLIYQELVNLHVEMEESLGKGGKNISNSLCQGRWQKELGSQITLVETKMAKRGVHAQPLEEYMSVSMVTGTYGLMIARSYVGRGDIVTEDTFKWVSSYPPIIKASCVIVRLMDDIVSHKEEQERGHVASSIECYSKESGASEEEACEYISRKVEDAWKVINRESLRPTAVPFPLLMPAINLARMCEVLYSVNDGFTHAEGDMKSYMKSFFVHPMVV

SEQ ID NO: 3840 - protein, 164 aa, Arabidopsis thaliana
MEWSLPVDLQEEILSRVPAKSLARWKSTPKQWKGPISIEFLHLLRSTLKFPLLNLHLKSKSIYVTSFTAMVFCYAPPSTKDSRFGIHVQGKPSGFLADEQNKVVVCCKWRSDSINTIYFVGENKHVQVDQRRGDLTLGQSCSFLMNYVPSFVQIQQGTLLAPRT

SEQ ID NO: 3841 - protein, 200 aa, Nicotiana tabacum
LVHQTNFAATSTFIAREVAKGLMKYQPDIIISVHPLMQHVPLRILRSKGLLKKIIFTTVITDLSTCHPTWFHKLVTRCYCPSEEVAKRALRAGLKPYQLKVYGLPVRPSFVKPVPPKVELRKELGMEEHLPAVLLMGGGEGMGPIEATARALGDALYDEIHGEPIGQVLVICGRNKKLFNRLTSVQWKIPVQVKGFVTKM

SEQ ID NO: 3842 - protein, 99 aa, Nicotiana tabacum
LMKYQPDIIISVHPLMQHVPLRILRSKGLLKKIIFTTVITDLSTCHPTWFHKLVTRCYCPSEEVAKRALRAGLKPYQLKVYGLPVRPSFVKPVPPKVEL

SEQ ID NO: 3843 - protein, 200 aa, Glycine max
HQSNFAATGTFIAREVAKGLMKYQPDIIISVHPLMQHVPLRILRSKGLLKKIVFTTVITDLSTCHPTWFHKLVTRCYCPTTDVAQRALKAGLQQSQIKIFGLPVRPSFVKPVQPKDELRRELGMDEDLPAVLLMGGGEGMGPIEATARALGDSLYDENIGAPVGQILVICGRNKKLANKLSSINWKVPVQVKGFVTKMEE

SEQ ID NO: 3844 - protein, 29 aa, Glycine max
LLKKIVFTTVITDLSTCHPTWFHKLVTRC

SEQ ID NO: 3845 - protein, 147 aa, Callithrix jacchus
MSNFTAEDKAAITSLWAKVNVEDAGGETLGRLLVVYPWTQRFFDSFGSLSSPSAIMGNPKVKAHGVKVLTSLGEAIKNLDDLKGTFGQLSELHCDKLHVDPENFRLLGNVLVTVLAILYGKEFTPEVQASWQKMVAGVASALASRYH

SEQ ID NO: 3846 - protein, 381 aa, Macaca mulatta
MGPIGTEADENQTVEEMKVEQYGPQTTPRGELVPDPEPELIDSTKLIEVQVVLILAYCSIILLGVIGNSLVIHVVIKFKSMRTVTNFFIANLAVADLVVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKSHVSPGAANDHYHQRRQKTTKMLVCVVVVFAVSWLPLHAFQLAVDIDSHVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 3847 - protein, 170 aa, Macaca mulatta
EIVACTEKWPGEEKSIYGTVYSLSSLLILYVLPLGIISFSYTRIWSKLKSHVSPGAANDHYHQRRQKTTKMLVCVVVVFAVSWLPLHAFQLAVDIDSHVLDLKEYKLIFTVFHIIAMCSTFANPLLYGWMNSNYRKAFLSAFRCEQRLDAIHSEVSVTFKAKKNLEVRKN

SEQ ID NO: 3848 - protein, 51 aa, Macaca mulatta; identical to SEQ ID NO: 1624

SEQ ID NO: 3849 - protein, 77 aa, Sus scrofa
VSLVKVFAPYACGSGIPEIKTILSGFIIRGYLGKWTLIIKTITLVLAVSSGLSLGKEGPLVHVACCCGNILCHCFNK

SEQ ID NO: 3850 - protein, 91 aa, Sus scrofa
KWTLIIKTITLVLAVSSGLSLGKEGPLVHVACCCGNILCHCFNKYRKNEAKRREVLSAAAAAGVSVAFGAPIGGVLFSLEEVSYYFPLKTL

SEQ ID NO: 3851 - protein, 303 aa, Sus scrofa
MWPLVVVVLLGSAYCGSAQLIFNITKSVEFTVCNTTVTIPCFVNNMEAKNISELYVKWKFKGKDIFIFDGAQHISKPSEAFPSSKISPSELLHGIASLKMDKRDAVIGNYTCEVTELSREGETIIELKRRFVSWFSPNENILIVIFPILAILLFWGQFGILTLKYKSSYTKEKTIFLLVAGLMLTIIVIVGAILFIPGEYSTKNACGLGLIVIPTAILILLQYCVFMMALGMSSFTIAILILQVLGHVLSVVGLSLCVSECTPVHGPLLISGLGIIALAELLGLVYMKCVASDHKTIQPPRNN

SEQ ID NO: 3852 - protein, 434 aa, Macaca fascicularis
MPSEILLKIFSYLDAVSLLCAGCVSRRFYHLANDNFIWIRIYSTAFSPTRSNWKVNSVEKIAVSVSFLSVQDKEAGYWKKEYITKQIASVKAALADILKPVNPYTGLPVKTKEALRMFGLGWAIILKEKSGKEYIMEHVDLSVNDTSVTVIWYGKNWPCLASLSTLDLCGVTPVFMDWYKTPTKHRLRWHSLIAKYNLSHLTVSTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKKGNIENGHVKLIVIHLKNNREHLPLIGKVGLSWKTDILDGCIKSCSMMDVTLLDEHGKPFWCFSSPVCMRSPATPADGPSFLGQTYSVDYVDAEGRVHVELVWIRETEEYLIVNLVLYLSIAKINRWFGTEY

SEQ ID NO: 3853 - protein, 186 aa, Macaca fascicularis
VNSVEKIAVSVSFLSVQDKEAGYWKKEYITKQIASVKAALADILKPVNPYTGLPVKTKEALRMFGLGWAIILKEKSGKEYIMEHVDLSVNDTSVTVIWYGKNWPCLASLSTLDLCGVTPVFMDWYKTPTKHRLRWHSLIAKYNLSHLTVSTMIGCDRLIRIFCLHPGLLVGVWKKEEELAFVMANL

SEQ ID NO: 3854 - protein, 164 aa, Macaca fascicularis
VSVSFLSVQDKEAGYWKKEYITKQIASVKAALADILKPVNPYTGLPVKTKEALRMFGLGWAIILKEKSGKEYIMEHVDLSVNDTSVTVIWYGKNWPCLASLSTLDLCGVTPVFMDWYKTPTKHRLRWHSLIAKYNLSHLTVSTMIGCDRLIRIFCLHPGLLVGV

SEQ ID NO: 3855 - protein, 43 aa, Sus scrofa
MVSITLLALVYLPGVIAAIVQLHNGTKYKKFPHWLDRWMVTRK

SEQ ID NO: 3856 - protein, 129 aa, Sus scrofa
ENSMPKRPMLVHLHQTAHFDEFDCPPELQHKQELFPKWHLPIKIAAIVSSLTFLYTLLREVIHPFVTSHQQYFYKIPILVINKVLPMVSITLLALVYLPGVIAAIVQLHNGTKYKKFPHWLDRWMVTRK

SEQ ID NO: 3857 - protein, 529 aa, Macaca mulatta
MSVKWTSIILLIQLSFYFSSGSCGKVLVWAAEYSHWMNMKTILEELVQRGHEVTVLASSASILFDPNNSSALKIEVFPTSLTKTEFENIIRQQIKRWSELPKDTFWLYFSQIQEIMWRFGDISIKFCKDVVSNKKLMKKLQESRFDVVLADPIFPCSELLAELFNIPLVYSLRFTPGYVFEKHCGGFLFPPSYVPVVMSELSDQMTFMERVKNMIYVLYFDFCFQLYDMKKWDQFYSEVLGRHTTLSEIMGKADIWLIRNSWNFQFPHPLLPNVDFIGGLLCKPAKPLPKEMEEFVQSSGENGVVVFTLGSMITNMKEERANVIASALAQIPQKVLWRFDGNKPDTLGVNTRLYKWIPQNDLLGHPKTKAFITHGGANGIYEAIYHGVPMVGIPLFADQPDNIAHMKTRGAAVQLDFDTMSSTDLANALKTVINDPLYKENVMKLSRIQRDQPVKPLDRAVFWIEFVMRHKGAKHLRPAAHDLTWFQYHSLDVIGFLLACVATVIFIIMKCCLFCFWKFTRKGKKGKSD

SEQ ID NO: 3858 - protein, 162 aa, Chlorocebus aethiops
MAPIKVGDAIPAVEVFEGEPGNKVNLAELFKGKKGVLFGVPGAFTPGCSKTHLPGFVEQAEALKAKGVQVLACLSVNDAFVTGEWGRAHKAEGKVRLLADPTGAFGKETDLLLDDSLVSIFGNRRLKRFSMVVQDGIVKALNVEPDGTGLTCSLAPSIISQL

SEQ ID NO: 3859 - protein, 162 aa, Papio hamadryas
MAPIKVGDAIPAVEVFEGEPGNKVNLAELFKGKKGVLFGVPGAFTPGCSKTHLPGFVEQAEALKAKGVQVLACLSVNDAFVTGEWGRAHKVEGKVRLLADPTGAFGKETDLLLDDSLVSIFGNRRLKRFSMVVQDGIVKALNVEPDGTGLTCSLAPSIISQL

SEQ ID NO: 3860 - protein, 147 aa, Callicebus moloch
MSNFTAEDKAAITSLWGKVNVEDAGGETLGRLLVVYPWTQRFFDSFGSLSSPSAIMGNPKVKAHGVKVLTSLGEAIKNLDDLKGTFDQLSELHCDKLHVDPENFRLLGNVLVTVLAILHGKEFTPEVQASRQKMVAGVASALGSRYH

SEQ ID NO: 3861 - protein, 958 aa, Macaca fascicularis
QKKSQDLESVQEVGGSYWQRVTLILELLQHKKKLKSPQILVPTLFNLLSRCLEPLPQEQGNMEYTKQLILSCLLNICQKLSPDGGKIPKDVLDEEKFNVELIVQCVRLSEMAQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWVLLILLFEQYVTKTVLAAAYGEKDAILEADTEFWFSVCCEFSVQHQIQSLMNILQYLLKLPEEKEETISKAVSNKSESQEEMLQIFNVETHTSKQLRHFKFLSVSFMSQLLSSNNFLKKVVESGGPEILKGLEERLLETVLGYINAVAQSMERNADKLTVKFWRALLSKAYDLLDKVNALLPTETFIPVIRGLVGNRLPSVRRKALDLLNNKLQQNISWKKTIVTRFLKLVPDLLAIVQRKKKEGEEEQAINRQTALYTLKLLCKNFGAENPDPFVPVLSTAVKLIAPERKEEKNVLGSALLCVAEVTSTLQALAVPQLPSLMPSLLTTMKNTSELVSSEVYLLSALAALQKVVETLPHFISPYLEGILSQVIHLEKITSEVGSASSQANIRLTSLKKTLATTLAPRVLLPAIRKTYKQIEKNWKNHMGPFMSILQEHIGVMKKEELTSHQSQLTAFFLEALDFRAQHSENDLEEVGRTENCIIDCLVAMVVKLSEVTFRPLFFKLFDWAKTEDAPKDRLLTFYNLADCIAEKLKGLFTLFAGHLVKPFADTLNQVNISKTDEAFFDSENDPEKCCLLLQFILNCLYKIFLFDTQHFISKERAEALMMPLVDQLENRLGGEEKFQERVTKQLIPCIAQFSVAMADDSLWKPLNYQILLKTRDASPKVRFAALITVLALAEKLKENYIVLLPESIPFLAELMEDECEEVEHQCQKTIQQLETVLGEPLRSYF

SEQ ID NO: 3862 - protein, 106 aa, Macaca fascicularis
VLAGIPAPVYFGVLIDTSCLKWGFKRCGSRGSCRLYDSNVFRHIYLGLTVILGTVSIFLSIAVLFILKKNYVSKHRNFITKRERTMVSTRFQKENCTTSDHLLQPK

SEQ ID NO: 3863 - protein, 75 aa, Macaca fascicularis
VLIDTSCLKWGFKRCGSRGSCRLYDSNVFRHIYLGLTVILGTVSIFLSIAVLFILKKNYVSKHRNFITKRERTMV

SEQ ID NO: 3864 - protein, 375 aa, Trichomonas vaginalis
MFSIDLIQQIKEWKRGSTLPICLGCDVGGSGLRVRLSDFHDSAKYVDLGHAKAQKTAELLKVLEDLQQKILQVEPTTVCLGAAIAVAGPIKNNTVILTNWKGPAEERTLSITQLPKGLFPKDRSYFLNDLEAGAYGVIAAYEQSILEENFVQLFTDRAPTGPILAKGRTAVLAMGSGLGAALVTRTPLLKNPLVLPTELGHLQIAPNMATHKYFQDEQELIQHISDHYYGGKLDPEYEDICSGRGLQLAFQFYHKKLTGEVLPLEQIDAGDVAKKAIAGEKDAYNALRAHYIFYLRAAKAIATSLSCESCVLSLDNQVKNHPFVMKIAKELEEEFYEFIRPDWMTSVRVYSQKSILNFNILGTDYMAHAIANKPQ

SEQ ID NO: 3865 - protein, 149 aa, Kluyveromyces lactis
VALLPVDNCSADLNISLQKAKPIAFIYERIISEIQHDVTEIVIDSTFCLSTDYKQYFVVVASFFGKGVPVGFMATETNNVDHLTILWFLRSVLQKLPKVKCINSDWSLAEIKAINLLKCSNQICLFHTLTAIRCKRLASKKNMTESLFH

SEQ ID NO: 3866 - protein, 70 aa, Kluyveromyces lactis
VVASFFGKGVPVGFMATETNNVDHLTILWFLRSVLQKLPKVKCINSDWSLAEIKAINLLKCSNQICLFHT

SEQ ID NO: 3867 - protein, 45 aa, Schizosaccharomyces pombe
VVIIAVAMVKILYICHWLIYKILILAFGIKVKPLGDTLPTHNGET

SEQ ID NO: 3868 - protein, 52 aa, Schizosaccharomyces pombe
AVAMVKILYICHWLIYKILILAFGIKVKPLGDTLPTHNGETGSHSKATVGSD

SEQ ID NO: 3869 - protein, 519 aa, Schizosaccharomyces pombe
MATVPTYHDLSFYSNPKENKARYAKLLNSFEQKYHCKPDFFSRSPGRVNIIGEHIDYNYFSVLPMAIDVDVIVSVTTSDDAKVELNNTNPEFKEEILELPSDGAVIEINKTHHTWGNYFRCSMIVAHKYILEKYPELVSGGKKPLKGLKLIFDGNVPTGGGLSSSAAFCVASILAILKANGINTITKEDLVKISVVSEHYVGVNTGGMDQCASIYGEQNKALLVQFKPKLMATPFKMPVLKPHDMVFLISNTLVEANKQETALTNYNLRVVEMAVASEFLAKKFNLELPKESNLHTGTLRGFMDEYYEKHLKQPHWDGSDIDMGVQRMQEMLRLTEIMFSEEQKVGFKTEELAKELGLSVEEFTKVFLTKIPVKYERMKIYQRTVHVYSDAMRVLQVLKLFHQHKDSDDPQKFMLAFGRLLNDSQRSEDIYNNSSSPELREVCKISLANGGYGARTTGAGWGGSAVHLTTHDKLAKLVEALTEQYYKKQFPKITQSELNAAVVVSKPAAGSCIVQLAEY

SEQ ID NO: 3870 - protein, 46 aa, Schizosaccharomyces pombe
VWLAKVNGMTKSDPIILHLHGGMMALPYDKVILVGLSNLYKLFSTT

SEQ ID NO: 3871 - protein, 136 aa, Schizosaccharomyces pombe
THKYDNQDMPDSVWLAKVNGMTKSDPIILHLHGGMMALPYDKVILVGLSNLYKLFSTTMNRPPSILLVDYSLVSQGYTYPKQVRECLNVYQVLISKGFRNITVLGESAGGTLILSFLYQISELSKLNKVVWPKGVA

SEQ ID NO: 3872 - protein, 200 aa, Schizosaccharomyces pombe
MTTELRRKLVIVGDGACGKTCLLIVFSKGTFPEVYVPTVFENYVADVEVDGRHIELALWDTAGQEDYDRLRPLSYPDSHVVLICFSVDAPESLDNVQEKWISEVLHFCSNLPILLVGCKVDLRNDPKTIEELSKTSQKPITFEEGQVVAQKIGAYKYLECSAKLNEGVNEVFETAARASMLKFKPASVPKTKKKKHCILL

SEQ ID NO: 3873 - protein, 74 aa, Schizosaccharomyces pombe
VSMVQSYALKTIDAIFELSAYDMSRCSDHVLFHAGFASASLLRLIYAAKTKEVDTSIVQPKVLNDLVTKIWKWL

SEQ ID NO: 3874 - protein, 70 aa, Schizosaccharomyces pombe
MVQSYALKTIDAIFELSAYDMSRCSDHVLFHAGFASASLLRLIYAAKTKEVDTSIVQPKVLNDLVTKIWK

SEQ ID NO: 3875 - protein, 280 aa, Schizosaccharomyces pombe
MSNPESLKKQVEPPGYNELFMVEDVCNVDLEQGLDLCKPEKVNKQSQRSRQSRQSLFTNTIKPQKDKMNIKTNKIKEFLNDLFTEFSKFHNSYYPDGRISTRSNFRWPLLIIWSIIIVFAVDKKFEVQKFLSIWINENRFYSEIWVPIAIYVCLLVLMLLSLIFFAEFAVLALRVTGVIIAVLGAVLGMIIAVLGMIIAALGMIIAALGATITGLLYFGHWALYKLVILSLGFKIVTPGDVCVSNTLPTHNGETALHSETTVGSDIEQIELQNMPTPVKK

SEQ ID NO: 3876 - protein, 362 aa, Pseudomonas aeruginosa
MKPLLHAFAPGVMALMLLLPQAAQAKEVAPQQKLSNVVILATGGTIAGAGASAANSATYTAAKVPVDQLLASVPQLKDIANVRGEQVFQIASESFTNENLLELGKTVAKLADSDDVDGIVITHGTDTLEETAYFLTLVEHTEKPIVVVGSMRPGTAMSADGMLNLYNAVAVAGDKSARGKGVLITMNDEILSGRDASKMVNIKTEAFKSPWGPLGMVVEGKSYWFRAPVKRHTVNSEFDIKQISALAPVEIAYSYGNVSDTAYKALAQAGAKAIIHAGTGNGSVPARVVPTLQELRKQGVQIIRSSHVNAGGFVLRNAEQPDDKNDWIVAHDLNPQKARILAAVAMTKTQDSKELQRIFWEY

SEQ ID NO: 3877 - protein, 646 aa, Torpedo marmorata
MGCCGCGSEEGSVRQWKPLEQRSCTDVLWLLIFVLFCIGMAIICGFAIASGAAQRLVFGYDSYGNICGHKNTEIKDVTMSGLDHTDKKYVFFFEPCNWDMVHLKILSVALCVTKCPDMDLKTLEDVRNFAKYNGSRLCLYNLDPTQYTSKNSKSCPILPVKSSKPIPFFHRCVPMDSGCKINFKALTTFVSYNSVLQRVITGVMTSKEIIVGLCLMSLVLSILLMVIIRYISKVLVWILAILTIIGSIGGTAVLWWLYADHKKTLKLDPSQGDVAADNVTALLVCAIIATVITVILLLLMLIMRKRVALTIALFHVAGKVFIHIPFLIFQSLWTFLALAFFWIYWIAVLLLLATAGYPQKKDQGYVEFKVSGPLQYTWIYHLVGLIWISEFILACQQMTIAGAVVTYYFTRDKHNLPATPILASMCRLIKYHLGTVAKGSFIITLIKIPQMILVYIHSQLKGKENACAKCMLKACMCCLWCLEKCLLYLNRNAYIATSINGTSFCTSAKDAIVILVENAMRVAAINTVGDFVLFLGKLLIVLVTGFVGIILLNYQRDYTVWVLPLIIICLFAFFVSHCFLSIYEMVVDVLFLCFAVDCKHNDGSPGREYYMDKSLMEFMDESRKAMRSVTGSGAEMKSMASGSDNA

SEQ ID NO: 3878 - protein, 116 aa, Gallus gallus
VVLTLTWFLAAGKKWGHEAIEAHSSYFHMAAWGIPAMKTIVILTMRKVAGDELTGLCYVGSMDVSALTGFVLIPLSCYLVVGTSFILTGFVALFHIRKIMKTGGTNTEKLEKLMVK

SEQ ID NO: 3879 - protein, 108 aa, Gallus gallus
LAAGKKWGHEAIEAHSSYFHMAAWGIPAMKTIVILTMRKVAGDELTGLCYVGSMDVSALTGFVLIPLSCYLVVGTSFILTGFVALFHIRKIMKTGGTNTEKLEKLMVK

SEQ ID NO: 3880 - protein, 237 aa, Paralichthys olivaceus
  MOD_RES (187)..(187): Any amino acid
MNVFDRNINFDSLFKFSQISHSTQVHLKNVYSSLAVCMFVAAAGSYVHVVTRLFQGGMLSVLGSLGMMFWLAMTPHNSETEKKRLAILAGFAFLTGVGLCPTLDFVIAINPSIIVTAFLGTSVIFVCFTLSALYAKRRSYLFLGGTLMSGLSILFLMSMMNMFFGSVMLFKAHMYLGLLIMCGFVLXDTQLIIEKAENGDKDYVWHSVDLFLDFITIFRKLMVILALNDKDKKKEKK

SEQ ID NO: 3881 - protein, 92 aa, Gallus gallus
ALCKKTVGSVLEEWCLNEPLFGCKRHQNVRKKLRLIRIIGLLVSVVAISTFSLSISAFFKMETHSTVLASSLESQKLVHGHQRTLLDFMEQN

SEQ ID NO: 3882 - protein, 63 aa, Gallus gallus
KKTVGSVLEEWCLNEPLFGCKRHQNVRKKLRLIRIIGLLVSVVAISTFSLSISAFFKMETHST

SEQ ID NO: 3883 - protein, 92 aa, Gallus gallus; identical to SEQ ID NO: 3881

SEQ ID NO: 3884 - protein, 63 aa, Gallus gallus; identical to SEQ ID NO: 3882

SEQ ID NO: 3885 - protein, 404 aa, Oryzias latipes
MALRVTRNRLASTRAELGGKTCSVAGPTQKPRAALGEIGNVAVINKDVTKKTIKTEVAKKTKIPAKAEKIELPKAAVVPVKPAPEVQVTEVPDQAEPASPTPMETSGCESADLCQAFSDVILNTAIRDVDADDYDNPMLCSEYVKDIYKYLRQLEMEQSVKPNYLEGQEITGNMRAILIDWLVQVGLKFRLLQETMYMTVGIIDRFLQDHPVPKKQLQLVGVTAMFLASKYEEMYPPEISDFAYVTDRAYTTAQIRDMEMTILRVLKFQLGRPLPLQFLRRASKIYEVTAEQHTLAKYLLELSMVDYDMAHFSPSLVASAALALTLKVLDAGEWDVTLQHYMEYTAETLTPVMAHIAKNVVKVNNGQTKHMAIKGKYSTSKQMRIATISQLKSSVVKDLATQIS

SEQ ID NO: 3886 - protein, 551 aa, Mus musculus
MKLLNYALVYRRFLLVVFTILVFLPLPLIIRTKVASAYFKDFHLLLIGVICLATSIEKWNLHKRIALRMVMMVGVNPAWLTLGFMSSTAFLSMWLSNTSTAAMVMPIVEAVAQQIISAEAEAEATQMTYFNESAAHGLDIDETVIGQETNEKKEKTKPAPGSSHDKGKVSRKMETEKNAVTGAKYRSRKDHMMCKLMCLSVAYSSTIGGLTTITGTSTNLIFSEHFNTRYPDCRCLNFGSWFLFSFPVALILLLLSWIWLQWLYLGFDFKMFKCGKTKTLKEKACAKVIKQEYEKLGPMRYQEIVTLVIFIVMALLWFSRDPGFVTGWSVLFSEYPGYVTDSTVALVAGILFFLIPAKKVTKMTSAGEIIAFDYTPLITWKEFQSFMPWDIAILVGGGFALADGCQVSGLSNWIGSKLSPLGSLPVWLIILISSLIVTSLTEVASNPATITILFPILSPLAEAIQVNPLQILLPSTLCTSFAFLLPVANPPNAIVFSYGHLKVIDMVKAGLGVNILGVAVVMLGMFTWIEPMFNLHEYPSWASNFVNQTMP

SEQ ID NO: 3887 - protein, 231 aa, Rattus norvegicus
MKNSMLEAASLLLEKLLLISNFKIFSVCAPGGGTGKKHPYEINSFLRGDVLEVSRTHFTHYGIYLGDNRVAHLMPDILLALTSDKERTQKVVSNKRLLPGVICKVASIRVDTVEDFAYGADILVNHLDETLKKKSLLNEEVARRAEQQLGLTPYSLLWNNCEHFVTYCRYGSPISPQAEKFHETVKILIRDQRSCLASAVLGLVSIIYTGLASYMTLPAVCIPFCLWMMSG

SEQ ID NO: 3888 - protein, 953 aa, Mus musculus
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLVELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDSNEAAAADVLEFVREAIQRFDNLRMLIVEKMLEVFHAIKSVKIYRGALWILGEYCSTKEDIQSVMTEVRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSQMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMTDLNDYLQHILKSTNMKCLTPEKALSGYCGFMAANLYARSIFGEDALANVSIEKPVHQGPDAAVTGHIRIRAKSQGMALSLGDKINLSQKKTSL

SEQ ID NO: 3889 - protein, 35 aa, Rattus norvegicus; identical to SEQ ID NO: 1655

SEQ ID NO: 3890 - protein, 63 aa, Rattus norvegicus; identical to SEQ ID NO: 1656

SEQ ID NO: 3891 - protein, 92 aa, Mus musculus
ISTMLLPLIKVLVVYPSEICFHHTVCRFTDFLQNYCRSEVILEKWQKKKIAEMGPVQWLTTQKQAADKVVFLLPSDVPTLCDSACGHNEGSA

SEQ ID NO: 3892 - protein, 46 aa, Mus musculus
TMLLPLIKVLVVYPSEICFHHTVCRFTDFLQNYCRSEVILEKWQKK

SEQ ID NO: 3893 - protein, 205 aa, Rattus norvegicus; identical to SEQ ID NO: 3391

SEQ ID NO: 3894 - protein, 199 aa, Rattus norvegicus
MDGQKKHWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNSTIKELRRLFLVDDLVDSLKFAVLMWVFTYVGALFNGLTLLILALISLFSIPVIYERHQVQIDHYLGLANKSVKDAMAKIQAKIPGLKRKAD

SEQ ID NO: 3895 - protein, 160 aa, Mus musculus
VILRSLTETLQNNVTPYVVSLQAKDCPDVKHFLQKFTSQLMDCCVDRHSKEVTSGKALKKTNYSMDSLCSWYSAVTQKADHKVTIKKRTASGHWRSPPVVLILKSMESFTSKVLQDFITISSQHLHEFPLILIFGIATSPVIIHRLLPHSVSSLLCVELF

SEQ ID NO: 3896 - protein, 70 aa, Mus musculus
AYKLHLECSLLINLVDWAEAFATVVTAAEKMDANSTVSEEMSEVIHARFIRAVSELELLGFIKPTKQKTD

SEQ ID NO: 3897 - protein, 160 aa, Mus musculus; identical to SEQ ID NO: 3895

SEQ ID NO: 3898 - protein, 70 aa, Mus musculus; identical to SEQ ID NO: 3896

SEQ ID NO: 3899 - protein, 184 aa, Mus musculus
MKPDETPMFDPSLLKEVDWSQNTAIFSPAISPTHPGEGLVLRPLCTADLNKGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFDYTVSEENYMCRRFLK

SEQ ID NO: 3900 - protein, 209 aa, Mus musculus
MALLAEHLLKPLPADRQIETGPFLEAVAHLPPFFDCLGSPVFTPIKADISGNITKIKAVYDTDPAKFKTLQNILEVEKGMYGAEWPKVGATLALLWLKRGLRFIQVFLQSICDGERDENHPNLIRVNANKAYEMALKKYHGWLVQKIFKAALYAAPYKSDFLKALSKGQNVTEEECLEKIRLFLVNYTATIDAIYDMYTKMNAELDYTV

SEQ ID NO: 3901 - protein, 507 aa, Mus musculus
MSQRQVLQVFEQYQKARTQFVQMVAELATRPQNIETLQNAGVMSLLRPLLLDVVPTIQQTAALALGRLANYNDDLAEAVVKGDILPQLVYSLAEQNRFYKKAAAFVLRAVGKHSPQLAQAIVDCGALDTLVICLEDFDPGVKEAAAWALGYIARHNTELSQAVVDAGAIPLLVLCIQEPEIALKRIAASALSDISKHSPELAQTVVDAGAIAHLAQMILNPDAKLKRQVLSALSQIAKHSVDLAEMVVEAEIFPVVLTCLKDKDEYVKKNACTLIREIAKHTPELSQLIVNAGGVAAVIDCIGSCKGNIRLPGIMMLGYVAAHSENLAMAVIISKGVPQLSICLSEEPEDHIKAAAAWALGQLGRHTPEHARAVAVTNTLPVLLSLYMSPESSEDLQLKSKKAIKNILQKCTYLPALEPFLYDAPPNILKHVVGQFSKVLPHDSKARRLFVTSGGLKKVQEIKAEPGSLLQEYINSINNCYPEEIVRYYSPGYSDTLLQRVDSYQPL

SEQ ID NO: 3902 - protein, 80 aa, Rattus norvegicus
ELAKKTKFHLCRHVLVTIILLVIINLLVIFIPSMKDIFGVVGVTSANMLIFILPSSLYLKITNQDGDKNTQRIWAALFLA

SEQ ID NO: 3903 - protein, 71 aa, Rattus norvegicus
KKTKFHLCRHVLVTIILLVIINLLVIFIPSMKDIFGVVGVTSANMLIFILPSSLYLKITNQDGDKNTQRIW

SEQ ID NO: 3904 - protein, 216 aa, Bacillus subtilis
MSDKQVTTILFDLDGTLINTNELIIASFLHTLEHYYPSKYKREDVLAFIGPSLFDTFSSMDPDKCEDMIAMYRAYNHDMHDSLVTEYETVYETLDALKKAGFTLGIVTTKLRDTVNMGLKLTGIGEFFETVVTLDDVTNAKPDPEPVLLALKQLGSEPAEAIMVGDNYHDVLAGKNAGTKTAGVAWTIKGPEMLAKHEPDFMLEKMSDLLQIVGVK

SEQ ID NO: 3905 - protein, 280 aa, Neisseria meningitidis
MDIKINDITLGNNSPFVLFGGINVLESLDSTLQTCAHYVEVTRKLGIPYIFKASFDKANRSSIHSYRGVGLEEGLKIFEKVKAEFGIPVITDVHEPHQCQPVAEVCDVIQLPAFLARQTDLVVAMAKTGNVVNIKKPQFLSPSQMKNIVEKFHEAGNGKLILCERGSSFGYDNLVVDMLGFGVMKQTCGNLPVIFDVTHSLQTRDAGSAASGGRRAQALDLALAGMATRLAGLFLESHPDPKLAKCDGPSALPLHLLEDFLIRIKALDDLIKSQPILTIE

SEQ ID NO: 3906 - protein, 301 aa, Moritella abyssi
MENLLSVKDLSKQQILDLLALAKAVKANPAEYSQALAGKSIVTIYEKPSLRTRVTFDIGIHKLGGHAVYLDAQNGAIGERETVKDFAANISRWADAIVARVVSHKTLEGLVEHGSVPVVNSLCDLYHPCQALADFLTISEHYEDVSKVKLAYVGEGNNVTHSLMLTGAILGAEVTAVCPRGSSPDAQIVKQAMALAEISGGKINVTDNLDDIVDYDVIYGDTWVSMGDDTPLAQVKEKYMPYQINKALLMRTGIKHVLHCQPAHRELEITSEVMDGEHSLIFDQAENRMHAQNAVLLTLLK

SEQ ID NO: 3907 - protein, 563 aa, Bacillus halodurans
MTTKYTIGVDYGTESGRAVLIDLSNGQELADHVTPYRHGVIDQYLPNTNIKLGHEWALQHPLDYVEVLTTSVPAVMKESGVDADDVIGIGVDFTACTMLPVDEEGQPLCLLAQYKDNPHSWVKLWKHHAAQDKANAINEMAEKRGEAFLPRYGGKISSEWMIAKVWQILDEAEDVYNRTDQFLEATDWIVSQMTGKIVKNSCTAGYKAIWHKREGYPSNEFFKALDPRLEHLTTTKLRGDIVPLGERAGGLLPEMAEKMGLNPGIAVAVGNVDAHAAVPAVGVTTPGKLVMAMGTSICHMLLGEKEQEVEGMCGVVEDGIIPGYLGYEAGQSAVGDIFAWFVKHGVSAATFDEAQEKGVNVHALLEEKASQLRPGESGLLALDWWNGNRSILVDTELSGMLLGYTLQTKPEEIYRALLEATAFGTRAIVDAFHGRGVEVHELYACGGLPQKNHLLMQIFADVTNREIKVAASKQTPALGAAMFASVAAGSEVGGYDSIEEAAKKMGRVKDETFKPIPEHVAIYEKLYQEYVTLHDYFGRGANDVMKRLKALKSIQHRPSSLLT

SEQ ID NO: 3908 - protein, 361 aa, Vibrio cholerae
MERITVNLGERSYPISIGAGLFANPALLSLSAKQKVVIVTNHTVAPLYAPAIISLLDHIGCQHALLELPDGEQYKTLETFNTVMSFLLEHNYSRDVVVIALGGGVIGDLVGFAAACYQRGVDFIQIPTTLLSQVDSSVGGKTAVNHPLGKNMIGAFYQPKAVVIDTDCLTTLPAREFAAGMAEVIKYGIIYDSAFFDWLEAQMEALYALDEQALTYAIARCCQIKAEVVAQDEKESGIRALLNLGHTFGHAIEAHMGYGNWLHGEAVSAGTVMAAKTAQLQGLIDASQFERILAILKKAHLPVRTPENMTFADFMQHMMRDKKVLAGELRLVLPTSIGTSAVVKGVPEAVIAQAIEYCRTV

SEQ ID NO: 3909 - protein, 241 aa, Staphylococcus aureus; identical to SEQ ID NO: 2540

SEQ ID NO: 3910 - protein, 105 aa, Arabidopsis thaliana
HAKEVQTWTKFFALSCLLAIFIDPLFFFLIKVQEQNKCIMIDWPMTKAFVAVRSVTDVIFTMNILLQFRLAYVARESTVVGAGQLVSHPKKIALHYLKGKFFLDL

SEQ ID NO: 3911 - protein, 77 aa, Arabidopsis thaliana
LIKVQEQNKCIMIDWPMTKAFVAVRSVTDVIFTMNILLQFRLAYVARESTVVGAGQLVSHPKKIALHYLKGKFFLDL

SEQ ID NO: 3912 - protein, 90 aa, Arabidopsis thaliana
TKQMVNPWKTYVKLSGVLMGSHGLTKGSLAYLNYPAQIMFKSTKVLPVMVMGAFIPGLRRKYPVHEYISAMLLVIGLILFTLADAHTSPN

SEQ ID NO: 3913 - protein, 74 aa, Arabidopsis thaliana
WKTYVKLSGVLMGSHGLTKGSLAYLNYPAQIMFKSTKVLPVMVMGAFIPGLRRKYPVHEYISAMLLVIGLILFT

SEQ ID NO: 3914 - protein, 445 aa, Hevea brasiliensis
MAITIVSVRARQIFDSRGNPTVEADVKLSDGYLARAAVPRGASTGIYEALELRDGGSDYLGKGVSKAVENVNIIIGPALVGKDPTDQVGIDNFMVQQLDGTVNEWGWCKQKLGANAILAVSLAVCKAGAHVKGIPLYKHVANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNNGSQKISGDVLKDLYKSFVTEYPIVSIEDPFDQDDWEHYAKLTSEIGVKVQIVGDDLLVTNPKRVEKAIKEKACNALLLKVNQIGSVTESIEAVKMSKRAGWGVMASHRSGETEDTFIADLSVGLATGQIKTGAPCRSERLAKYNQLLRIEEELGAEAVYAGANFRTPVEPY

SEQ ID NO: 3915 - protein, 445 aa, Hevea brasiliensis [sequence omitted]

SEQ ID NO: 3916 - protein, 347 aa, Coptis japonica
MEVKKDNLSSQAKLWNFIYGFAESLVLKCAVQLDLANIIHNSGTSMTLSELSSRLPSQPVNEDALYRVMRYLVHMKLFTKASIDGELRYGLAPPAKYLVKGWDKCMVGSILAITDKDFMAPWHYLKDGLSGESGTAFEKALGTNIWGYMAEHPEKNQLFNEAMANDSRLIMSALVKECGNIFNGITTLVDVGGGTGTAVRNIANAFPHIKCTVYDLPHVIADSPGYSEVHCVAGDMFKFIPKADAIMMKCILHDWDDKECIEILKRCKEAVPVKGGKVIIVDIVLNVQSEHPYTKMRLTLDLDMMLNTGGKERTEEEWKKLIHDAGYKGHKITQITAVQSVIEAYPY

SEQ ID NO: 3917 - protein, 411 aa, Arabidopsis thaliana
MGTCRESEPTQIFVPGPIIVGAGPSGLAVAACLSNRGVPSVILERTDCLASLWQKRTYDRLKLHLPKHFCELPLMPFPKNFPKYPSKQLFISYVESYAARFNIKPVFNQTVEKAEFDDASGLWNVKTQDGVYTSTWLVVATGENAEPVFPNIPGLKKFTGPVVHTSAYKSGSAFANRKVLVVGCGNSGMEVSLDLCRYNALPHMVVRNSVHVLPRDFFGLSTFGIAMTLLKWFPLKLVDKFLLLLANSTLGNTDLLGLRRPKTGPIELKNVTGKTPVLDVGAISLIRSGQIKVTQAVKEITRNGAKFLNGKEIEFDSIILATGYKSNVPDWLKENSFFTKEGMPKTPFPNGWKGEKGLYTVGFTRRGLSGTAYDAVKIAEDITDQWMKFNGPLSCRNICSSHIIHLHFNKS

SEQ ID NO: 3918 - protein, 73 aa, Arabidopsis thaliana
KKELYKLMTMPTRVFIVHMLPDLGSRLFSIAKEIDMLSKGYVWIVTNGIADLMSIMGESSLVNMHGVLGVKTY

SEQ ID NO: 3919 - protein, 200 aa, Arabidopsis thaliana
VFIVHMLPDLGSRLFSIAKEIDMLSKGYVWIVTNGIADLMSIMGESSLVNMHGVLGVKTYFAKSKELLHLEARWQKRFGGEELNNFACWAYDAATALAMSVEEIRHVNMSFNTTKEDTSRDDIGTDLDELGVALSGPKLLDALSTVSFKGVAGRFQLKNGKLEATTFKIINIEESGERTVGFWKSKVGLVKSLRVDKVSH

SEQ ID NO: 3920 - protein, 1017 aa, Arabidopsis thaliana
MRRNVSDHAEKKDKVGVEVLLELPKTLSKSNKKWQLALIKLYCSRTLLNCAKHAIRKPGLFPRSLSYTAIDLDHHHGDDHFKIDTETLNDLVKNKNQEKLESLGGPNGLVSALKSNTRLGINEEGDEIQRRRSTFGSNTYTRQPSKGLFHFVVEAFKDLTILILLGCATLSLGFGIKEHGLKEGWYDGGSIFVAVFLVVAVSAVSNFRQNRQFDKLSKVSSNIKIDVVRNGRRQEISIFDIVVGDIVCLNIGDQVPADGVFVEGHLLHVDESSMTGESDHVEVSLTGNTFLFSGTKIADGFGKMAVTSVGMNTAWGQMMSHISRDTNEQTPLQSRLDKLTSSIGKVGLLVAFLVLLVLLIRYFTGTTKDESGNREYNGKTTKSDEIVNAVVKMVAAAVTIIVVAIPEGLPLAVTLTLAYSMKRMMKDNAMVRKLSACETMGSATVICTDKTGTLTLNQMKVTDFWFGLESGKASSVSQRVVELFHQGVAMNTTGSVFKAKAGTEYEFSGSPTEKAILSWAVEELEMGMEKVIEEHDVVHVEGFNSEKKRSGVLMKKKGVNTENNVVHWKGAAEKILAMCSTFCDGSGVVREMKEDDKIQFEKIIQSMAAKSLRCIAFAYSEDNEDNKKLKEEKLSLLGIIGIKDPCRPGVKKAVEDCQFAGVNIKMITGDNIFTARAIAVECGILTPEDEMNSEAVLEGEKFRNYTQEERLEKVERIKVMARSSPFDKLLMVKCLKELGHVVAVTGDGTNDAPALKEADIGLSMGIQGTEVAKESSDIVILDDNFASVATVLKWGRCVYNNIQKFIQFQLTVNVAALVINFVAAVSAGDVPLTAVQLLWVNLIMDTLGALALATEKPTNDLMKKKPIGRVAPLITNIMWRNLLAQAFYQISVLLVLQFRGRSIFNVTEKVKNTLIFNTFVLCQVFNEFNARSLEKKNVFKGLHKNRLFIGIIVVTVVLQVVMVEFLKRFADTERLNLGQWGVCIAIAAASWPIGWLVKSVPVPERHFFSYLKWKKRS

SEQ ID NO: 3921 - protein, 500 aa, Arabidopsis thaliana
MAHIWLLPLIFLVCILLAVFNHKKHPKYRQFPCPPGFPIIGNLHQIGELPHQTLWKLSKKYGPVMHLMLGRVPTVVVSSSDTARQVLRVHDLHCCTRPSLSGPRELSYNYLDIAFSPYDDYWKEVRKLCVQELFSTKQVHSIQPIKDEEVKKMIDSIAESASQKNPVNLNNKCLELTVSVVCRTAFGVSFEGTVLNSDRFNKIVREALEMLGSFSAADFIPYVGWIIDVLTGLQGRRERSKRDLNAFFEQMFDLHKEGKKEGNEDFVDLLLRLEKEEAVLGNDKLTRNHIKAILLDVLLAGIDTSAITMTWAMTELARNPRVMKKVQSEIRTQMGNRSMISFEDMDQLEYLKMVIKETWRLHPTTPLLLPREAMSEFDINGYTIPVKTRLHVNVWAIGRDPDTWKDPEVFLPERFMDNNIDAKGQHFELLPFGGGRRICPAIYMGTTMVEFGLANLLYHFDWKLPEGVEVKDIDVEEAPGLTVNKKNELLLVPEMRRSCG

SEQ ID NO: 3922 - protein, 310 aa, Arabidopsis thaliana
MTNIWLLSLIFVICILVAVFNHKNRRNYQRTPPSPPGCPIIGNLHQLGELPHQSLWKLSKKYGPVMLLKLGRVPTVIVSSSETAKQALKIHDLHCCSRPGFAGARELSYNYLDIAFSPYDDYWKEVRKLAVQELFSSKQVHSIQPIKDEEVKKLIDSISESAAQKTPINLNKTLLALTVSVVCRTAFSVNFEGTVLNSERFNNIVREALEMLGSFSASDFIPYVGRIIDLLTGLQGRRERSMRDLDAFYEQMFDLHKQKKEEGSEDFVDLLLRLEKEEAVLGNDKLTRNHIKAILMVTNHIFTIKSVRKI

SEQ ID NO: 3923 - protein, 485 aa, Arabidopsis thaliana
MALLVEKTSSGREYKVKDMSQADFGRLEIELAEVEMPGLVSCVTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKNGTFPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 3924 - protein, 89 aa, Arabidopsis thaliana
ITIKPQTDRWVFPDTNSGIIVLAEGRLMNLGCATGHPSFVMSCSFTNQVIAQLELWNEKSSGKYEKKVYVLPKHLDEKVAALHLGKLGA

SEQ ID NO: 3925 - protein, 120 aa, Arabidopsis thaliana
IQKQISASSPARKFLALTLIKVSLAYTEMKRVYEGLCLTKNQKPPMYIVSLVDWLWARVVAFFLWPLHMLAEKLVHRKIRSSIGITKAGVSGGGSLPMHVDKFFEAIGVNVQNGYGLTET

SEQ ID NO: 3926 - protein, 70 aa, Arabidopsis thaliana
TLIKVSLAYTEMKRVYEGLCLTKNQKPPMYIVSLVDWLWARVVAFFLWPLHMLAEKLVHRKIRSSIGITK

SEQ ID NO: 3927 - protein, 126 aa, Arabidopsis thaliana
ANPIVMVEPFVKDYLGGDKVLGTEIEVNPKTMKATGFVKKPGVLVGDLKRLAILKEFGDDSPDLGLGDRTSDHDFMSICKEGYMVHETKSATTVPIESLKNRIIFHDGRLVQRPTPLNALIIYLWL

SEQ ID NO: 3928 - protein, 122 aa, Arabidopsis thaliana
VMVEPFVKDYLGGDKVLGTEIEVNPKTMKATGFVKKPGVLVGDLKRLAILKEFGDDSPDLGLGDRTSDHDFMSICKEGYMVHETKSATTVPIESLKNRIIFHDGRLVQRPTPLNALIIYLWL

SEQ ID NO: 3929 - protein, 328 aa, Arabidopsis thaliana
MADNTGSEMKSGSFMLEKSAKIFVAGHRGLVGSAIVRKLQDQGFTNLVLRTHSELDLTSQSDVESFFATEKPVYVILAAAKVGGIHANNTYPADFIGVNLQIQTNVIHSAYTHGVKKLLFLGSSCIYPKFAPQPIPESALLTGPLEPTNEWYAIAKIAGIKMCQAYRLQHQWDAISGMPTNLYGQNDNFHPENSHVLPALMRRFHEAKANNADEVVVWGSGSPLREFLHVDDLADACVFLMDQYSGFEHVNVGSGVEVTIKELAELVKEVVGFKGKLVWDTTKPDGTPRKLMDSSKLASLGWTPKISLKDGLSQTYEWYLENVVQKKQ

SEQ ID NO: 3930 - protein, 542 aa, Arabidopsis thaliana
MESQKQEDNEYIFRSLYPSVPIPDKLTLPEFVLQGVEEYTENVAFVEAVTGKAVTYGDVVRDTKRLAKALTSLGLRKGQVMVVVLPNVAEYGIIALGIMSAGGVFSGANPTALVSEIKKQVEASGARGIITDATNYEKVKSLGLPVIVLGEEKIEGAVNWKDLLEAGDKCGDTDNEEILQTDLCALPFSSGTTGLQKGVMLTHRNLIANLCSTLFGVRSEMIGQIVTLGLIPFFHIYGIVGICCATMKNKGKVVAMSRYDLRIFLNALIAHEVSFAPIVPPIILNLVKNPIVDEFDLSKLKLQSVMTAAAPLAPELLTAFEAKFPNVQVQEAYGLTEHSCITLTHGDPEKGQGIAKRNSVGFILPNLEVKFIDPDTGRSLPKNTSGELCVRSQCVMQGYFMNKEETDKTIDEQGWLHTGDIGYIDDDGDIFIVDRIKELIKYKGFQVAPAELEAILLTHPSVEDVAVVPLPDEEAGEIPAACVVINPKATEKEEDILNFVAANVAHYKKVRAVHFVDSIPKSLSGKIMRRLLRDKILSINKK

SEQ ID NO: 3931 - protein, 76 aa, Arabidopsis thaliana
IVFPGENTTEYKVDEKMEELGKQMIKHCGGLPLALKVLGGLLVVHFTLDEWKRIYGNIKSHIVGGTSFNDKNMSSV

SEQ ID NO: 3932 - protein, 65 aa, Arabidopsis thaliana
VFPGENTTEYKVDEKMEELGKQMIKHCGGLPLALKVLGGLLVVHFTLDEWKRIYGNIKSHIVGGT

SEQ ID NO: 3933 - protein, 76 aa, Arabidopsis thaliana; identical to SEQ ID NO: 3931

SEQ ID NO: 3934 - protein, 65 aa, Arabidopsis thaliana; identical to SEQ ID NO: 3932

SEQ ID NO: 3935 - protein, 235 aa, Arabidopsis thaliana
MSTLETTRAELGLVVVYLNKAEARDKICRAIQYGSKFLSDGQPGTAQNVDKNTSLARKVFRLFKFVNDLHALISPVPKGTPLPLVLLGKSKNALLSTFLFLDQIVWLGRTGIYKDKERAEILGRISLFCWMGSSVCTSLVEVGELGRLSASIKKLEKEIGNKDKHQNEQYRAKVEKSNERSLALIKAGMDVVVAFGLLQLAPKKVTPRVTGAFGFASSLISCYQLLPSHPKSKMV

SEQ ID NO: 3936 - protein, 543 aa, Arabidopsis thaliana
MSDRVHERSMGMEEEGSTKNMKTKVLELPTKIKKILKNIWKVGKDDPRRVKHALKVGVSLTLVSLLYLMEPLFKGIGNSAIWAVMTVVVVLEFSAGATLCKGLNRGLGTLIAGSLAFFIEFVANDSGKIFRAIFIGAAVFIIGALITYLRFIPYIKKNYDYGMLIFLLTFNLITVSSYRVDTVIKIAHERFYTIAMGVGICLLMSLLVFPIWSGEDLHKSTVAKLQGLSYSIEACVNEYFEEEEKDEETSDLSEDTIYNGYKTVLDSKSADEALAMYASWEPRHTRHCHRFPWKHYVKVGSVLRQFGYTVVALHGCLKTEIQTPRPLRGLFKDPCVRLAGEICKVLSELAASIRNRRHCSPEILSDSLQVALQDLNTAIKSQPKLFLGSSQNGNVSQGNSGRHNPNVAVSQHINKDTNEAASYQNTGTPRGERMSRFGPNVSFSRLRADTLERRSAAATNERKILRQQLSRIVVLTSLEFSEALPFAAFASLLVEMVARLDNVIEEVEELGTIACFKDYDNNVDQKDVEVRVEKPADLVVGVE

SEQ ID NO: 3937 - protein, 519 aa, Arabidopsis thaliana
MSDRVHERSMGMEEEGSTKNMKTKVLELPTKIKKILKNIWKVGKDDPRRVKHALKVGVSLTLVSLLYLMEPLFKGIGNSAIWAVMTVVVVLEFSAEFVANDSGKIFRAIFIGAAVFIIGALITYLRFIPYIKKNYDYGMLIFLLTFNLITVSSYRVDTVIKIAHERFYTIAMGVGICLLMSLLVFPIWSGEDLHKSTVAKLQGLSYSIEACVNEYFEEEEKDEETSDLSEDTIYNGYKTVLDSKSADEALAMYASWEPRHTRHCHRFPWKHYVKVGSVLRQFGYTVVALHGCLKTEIQTPRPLRGLFKDPCVRLAGEICKVLSELAASIRNRRHCSPEILSDSLQVALQDLNTAIKSQPKLFLGSSQNGNVSQGNSGRHNPNVAVSQHINKDTNEAASYQNTGTPRGERMSRFGPNVSFSRLRADTLERRSAAATNERKILRQQLSRIVVLTSLEFSEALPFAAFASLLVEMVARLDNVIEEVEELGTIACFKDYDNNVDQKDVEVRVEKPADLVVGVE

SEQ ID NO: 3938 - protein, 496 aa, Arabidopsis thaliana
MSDRVHERSMGMEEEGSTKNMKTKVLELPTKIKKILKNIWKVGKDDPRRVKHALKVGVSLTLVSLLYLMEPLFKGIGNSAIWAVMTVVVVLEFSAGALITYLRFIPYIKKNYDYGMLIFLLTFNLITVSSYRVDTVIKIAHERFYTIAMGVGICLLMSLLVFPIWSGEDLHKSTVAKLQGLSYSIEACVNEYFEEEEKDEETSDLSEDTIYNGYKTVLDSKSADEALAMYASWEPRHTRHCHRFPWKHYVKVGSVLRQFGYTVVALHGCLKTEIQTPRPLRGLFKDPCVRLAGEICKVLSELAASIRNRRHCSPEILSDSLQVALQDLNTAIKSQPKLFLGSSQNGNVSQGNSGRHNPNVAVSQHINKDTNEAASYQNTGTPRGERMSRFGPNVSFSRLRADTLERRSAAATNERKILRQQLSRIVVLTSLEFSEALPFAAFASLLVEMVARLDNVIEEVEELGTIACFKDYDNNVDQKDVEVRVEKPADLVVGVE

SEQ ID NO: 3939 - protein, 539 aa, Arabidopsis thaliana
MGYKVEARSMEISMEDEDSRKKRKKGLNLPKKMKKILRNLWNVGKEDPRRVIHALKVGVALTLVSLLYLMEPFFEGVGKNALWAVMTVVVVLEFSAGATLRKGLNRGLGTLIAGSLAFFIEWVAIHSGKILGGIFIGTSVFTIGSMITYMRFIPYIKKNYDYGMLVFLLTFNLITVSSYRVDTVIKIAHERLYTIGMGIGICLFMSLLFFPIWSGDDLHKSTITKLQGLSRCIEACVSEYFEEKLKDNETSDSESDDEDLIYNGYNTVLDSKSADEALAMYAKWEPRHTRRCNKFPSQQYIKVGSVLRKFGYTVVALHGCLQTEIQTPRSIRVLFKDPCVRLAGEICKVLSELSESIQNRRHCSSEILSDSLEAALKDLNSTIKSQPKLFLGSNLHSNITNKHLNGHVSYYNETNSNGTVSYHNDNNTNGCVLGETIEENDTVSPLPLNSVVSLSSLRSVKKSAATGEKRRLRKQLSKIAVMKSLEFSEALPFAAFASLLVEMVARLDTVIDEVEELGTIACFKEYDKTVEVRIENRLI

SEQ ID NO: 3940 - protein, 335 aa, Arabidopsis thaliana
MGYKVEARSMEISMEDEDSRKKRKKGLNLPKKMKKILRNLWNVGKEDPRRVIHALKVGVALTLVSLLYLMEPFFEGVGKNALWAVMTVVVVLEFSAGATLRKGLNRGLGTLIAGSLAFFIEWVAIHSGKILGGIFIGTSVFTIGSMITYMRFIPYIKKNYDYGMLVFLLTFNLITVSSYRVDTVIKIAHERLYTIGMGIGICLFMSLLFFPIWSGDDLHKSTITKLQGLSRCIEACVSEYFEEKLKDNETSDSESDDEDLIYNGYNTVLDSKSADEALAMYAKWEPRHTRRCNKFPSQQYIKVGSVLRKFGYTVVALHGCLQTEIQVIYSTFYLH

SEQ ID NO: 3941 - protein, 365 aa, Arabidopsis thaliana
MTEKSAELVRLNELKAFVSTKAGVKGLVDTKITEVPRIFHIPSSSTLSNNKPSDIFGLNLTVPIIDLGDGNTSAARNVLVSKIKEAAENWGFFQVINHGIPLTVLKDIKQGVRRFHEEDPEVKKQYFATDFNTRFAYNTNFDIHYSSPMNWKDSFTCYTCPQDPLKPEEIPLACRDVVIEYSKHVMELGGLLFQLLSEALGLDSEILKNMDCLKGLLMLCHYYPPCPQPDLTLGISKHTDNSFITILLQDQIGGLQVLHQDSWVDVTPVPGALVISIGDFMQLITNDKFLSMEHRVRANRDGPRISVACFVSSGVFPNSTVYGPIKELLSDENPAKYRDITIPEYTVGYLASIFDGKSHLSKFRI

SEQ ID NO: 3942 - protein, 1179 aa, Arabidopsis thaliana
MSSFRVGGKVVEKVDLCRKKQLVWRLDVWPFAILYTVWLTTIVPSIDFSDACIALGGLSAFHILVLLFTTWSVDFKCFVQFSKVNSIDQADACKVTPAKFSGSKEVVPLHFRSQMTDSASSGDMEEIFFDFRKQRFIYSKELGAFSKLPYPTKETFGHYLKCTGHGTEAKIATATEKWGRNVFDYPQPTFQKLMKENCMEPFFVFQVFCVGLWCLDEFWYYSVFTLFMLFMFESTMAKSRLKTLTDLRSVRVDSQTVMVYRSGKWVKLLGTDLLPGDVVSIGRPSTQTGGEDKTVPADMLLLVGSAIVNEAILTGESTPQWKVPIVGQRSDEKLSIKRNKNHVLFGGTKILQHSPDKSFSLKTPDGGCLAVVLRTGFETSQGKLMRTILFSTERVTANSWESGLFILFLVVFAVIAAGYVLVKGLEDPTRSKYKLLLGCSLIITSVIPPELPMELSIAVNTSLLALVRRGIFCTEPFRIPFAGKVDLCCFDKTGTLTSDDMEFRGVGGLSNCEEAETDMSKVPVRTLEILASCHALVFVENKLVGDPLEKAALKGIDWSYKADEKALPRRGNGNSVQIMQRYHFASHLKRMSVIVRIQEEYLAFVKGAPETIQERLVDVPAQYIETYKRYTRQGSRVLALAYKRLPDMMVSEARDMDRDAVESDLTFAGFAVFNCPIRPDSAPVLLELKNSSHDLVMITGDQALTACHVAGQVHIVSNPVLILGRSGSGNEYKWVSPDEKEIIPYSEKEIETLAETHDLCIGGDSIEMLQATSAVLRVIPFVKVFARVAPQQKELILTTFKAVGRGTLMCGDGTNDVGALKQAHVGVALLNNKLPLSPSDSSKDDKSKSKKSKLPLEPASKTITQNGEGSSKGKIPPQNRHLTAAELQRQKLKKIMDDLNNDEGDGRSAPLVKLGDASMASPFTAKHASVAPVTDIIRQGRSTLVTTLQMFKILGLNCLATAYVLSVMYLDGVKLGDVQATISGVLTAAFFLFISHARPLQTLSAERPHPSVFSVYLFLSLIGQFAVHLTFLVYSVKEAEKHMPEECIEPDASFHPNLVNTVSYMVSMMLQVATFAVNYMGHPFNQSIRENKPFFYALIAGAGFFTVIASDLFRDLNDSLKLVPLPQGLRDKLLIWASLMFIICYSWERLLRWAFPGKISSWKHKQRAVTANLEKKKKV

SEQ ID NO: 3943 - protein, 148 aa, Arabidopsis thaliana
MDYLGIDLSCAIGSLRNGEFPAKDCLLPLISKLLGYFLVAASMTVKLPQIMKIVDNKSVKGLSVVAFELEVIGYTISLAYCLNKDLPFSAFGELAFLLIQALILVACIYYFSQPLSVTTWVKAILYFAIAPTVFADLEELQKQKHWTT

SEQ ID NO: 3944 - protein, 502 aa, Arabidopsis thaliana
MAISLLCLFLITFVSLTIVGCKIKRSIWNLPPSPPKLPVIGNLHQVGELPHRSFRRLAERTGHVMLLHLGFVPVTVISSREAAEEVLRTHDLDCCSRPNLVGSRLISRGFKDLNFTPYGEEWKERRRFLVGELFCSKKLQSFIYIKEVECNFLVKKLSESAVDQSPVDLSKTLFWLAASILFRVAFGQSFHESEFTDTDKIDELVFETETAQGSFTCSDFFPIAGLGWLVDWISGQHKRLNDVFLKLDALLQHVIDDHSNPGRSKDHKDIVDVMLDVMHKQGKDDSLRLTIDHIKGLLTNIIIAGIDTGALTMIWTMTELARNPEIMKKVQGEIRDRLGNNRERITKEDLDKVPFLNLVIKETFRLHPVAPLLLPRETMAHVKVQGYDIPPKRRILVNAWAIGRDPKLWTDPEEFKPERFIDSPVDYRGQHFELLPFGSGRRICPGMAMGMATLELGLLNLLYFFDWKLPDGMSHKDIDTEEAGTLTVVKKVHLKLVPVRVP

SEQ ID NO: 3945 - protein, 502 aa, Arabidopsis thaliana
MAISLLCLFLITLVSLIFVVKKIKHSKWDLPPSPPTFPVIGNLHQVGELPHRSFQRLAERTGHVMLLHFGFVPVTVISSREAAEEVLRTHDLKCCTRPKLVGSRLISRGFKDISFTPYGEEWRERRKFLVRELFCFKKVQYFGYIVEEECNLLVKKLTESAVGRPPVDLSKSLFWLAASILFRIAFGQSFHDNKFIDEDKIDELIFETETAQASFTCSDFFPIAGLGWLADWISGKHRWLNNVFFKLDALFQRVIDDHSDPGRWKDHKDIVDVMLDVMHKQGKDDSLRLTIDHIKGFLTNIIIAGIDTGALTMIWAMTELARNPELMKNVQGEIRDSFGNNKERITKEDLNKVPFLNMVIKETFRLHPVAPLLLPRETMTHIKVQGYDIPPKRRILVNTWAIGRDPTLWINPEEFNPERFINNPVDYRGQHFELLPFGSGRRICPGMGLGITIVELGLLNLLYFFDWRAPDGMTHKDIDTEEAGILTVVKKVPLKLVPVRVQ

SEQ ID NO: 3946 - protein, 570 aa, Arabidopsis thaliana
MVLQQQTHFLTKKIDQEDEEEEPSHDFIFRSKLPDIFIPNHLPLTDYVFQRFSGDGDGDSSTTCIIDGATGRILTYADVQTNMRRIAAGIHRLGIRHGDVVMLLLPNSPEFALSFLAVAYLGAVSTTANPFYTQPEIAKQAKASAAKMIITKKCLVDKLTNLKNDGVLIVCLDDDGDNGVVSSSDDGCVSFTELTQADETELLKPKISPEDTVAMPYSSGTTGLPKGVMITHKGLVTSIAQKVDGENPNLNFTANDVILCFLPMFHIYALDALMLSAMRTGAALLIVPRFELNLVMELIQRYKVTVVPVAPPVVLAFIKSPETERYDLSSVRIMLSGAATLKKELEDAVRLKFPNAIFGQGYGMTESGTVAKSLAFAKNPFKTKSGACGTVIRNAEMKVVDTETGISLPRNKSGEICVRGHQLMKGYLNDPEATARTIDKDGWLHTGDIGFVDDDDEIFIVDRLKELIKFKGYQVAPAELEALLISHPSIDDAAVVAMKDEVADEVPVAFVARSQGSQLTEDDVKSYVNKQVVHYKRIKMVFFIEVIPKAVSGKILRKDLRAKLETMCSK

SEQ ID NO: 3947 - protein, 710 aa, Arabidopsis thaliana
MMIGKLWRSVGTVGKFDGRYDGVRTMVGKASNRAGVHVTDTVLFEETSFEFSPSLTPELNEFPMPSLDVITPQAYLTPLGSQSINHAKFLQIPWRQFVFTKPLGLSKSTKLDEAVTLIENSSSSPSNLSTPEAYTDLLHACISAKSLHHGIKICSLILNNPSLRHNPKLLSKLITLFSVCRRLDLARKIFDDVTDSSLLTEKVWAAMAIGYSRNGSPRDALIVYVDMLCSFIEPGNFSISVALKACVDLKDLRVGRGIHAQIVKRKEKVDQVVYNVLLKLYMESGLFDDARKVFDGMSERNVVTWNSLISVLSKKVRVHEMFNLFRKMQEEMIGFSWATLTTILPACSRVAALLTGKEIHAQILKSKEKPDVPLLNSLMDMYGKCGEVEYSRRVFDVMLTKDLASWNIMLNCYAINGNIEEVINLFEWMIESGVAPDGITFVALLSGCSDTGLTEYGLSLFERMKTEFRVSPALEHYACLVDILGRAGKIKEAVKVIETMPFKPSASIWGSLLNSCRLHGNVSVGEIAAKELFVLEPHNPGNYVMVSNIYADAKMWDNVDKIREMMKQRGVKKEAGCSWVQVKDKIQIFVAGGGYEFRNSDEYKKVWTELQEAIEKSGYSPNTSVVLHDVDEETKANWVCGHSERLATTYSLIHTGEGVPIRITKNLRVCADCHSWMKIVSQVTRRVIVLRDTKRFHHFVDGICSCKDYW

SEQ ID NO: 3948 - protein, 800 aa, Arabidopsis thaliana
MASTNVTGQCPGPMKATSNGAFQNESPLDFALPLIILQIVLVVVFTRLLAYFLKPLKQPRVIAEIIGGILLGPSALGRSKAYLDTIFPKKSLTVLDTLANIGLLFFLFLVGLELDFAAIKKTGKKSLLIAIAGISLPFIVGVGTSFVLSATISKGVDQLPFIVFMGVALSITAFPVLARILAELKLLTTDIGRMAMSAAGVNDVAAWILLALAIALSGDGTSPLVSVWVLLCGTGFVIFAVVAIKPLLAYMARRCPEGEPVKELYVCVTLTVVLAASFVTDTIGIHALFGAFVVGIVAPKEGPFCRILTEKIEDLVSGLLLPLYFAASGLKTDVTTIRGAQSWGLLVLVILTTCFGKIVGTVGSSMLCKVPFREAVTLGFLMNTKGLVELIVLNIGKDRKVLNDQAFAILVLMALFTTFITTPIVMLIYKPARKGAPYKHRTIQRKDHDSELRILACFHSTRNIPTLINLIESSRGTGKKGRLCVYAMHLMELSERSSAIAMVHKARNNGLPIWNKIERSTDQMVIAFEAYQHLRAVAVRPMTAISGLSSIHEDICTSAHQKRVAMILLPFHKHQRMDGAMESIGHRFHEVNQRVLQRAPCSVGILVDRGLGGTSQVVASEVAYKVVIPFFGGLDDREALAYGMKMVEHPGITLTVYKFVAARGTLKRFEKSEHDEKEKKEKETDEEFVRELMNDPRGNESLAYEERVVESKDDIIATLKSMSKCNLFVVGRNAAVASLVKSTDCPELGPVGRLLSSSEFSTTASVLVVQGYDPAADTRPLVEEDAEYDQSSRDISDLTA

SEQ ID NO: 3949 - protein, 62 aa, Arabidopsis thaliana
TTDLVYHLIEINSSSESVVKFCDLPCGTSNFLKDAFVLRVFEGDRFSLLKQCHATKKIEIWV

SEQ ID NO: 3950 - protein, 68 aa, Arabidopsis thaliana
TFINNHKMTFRFILATKSKIYSVSIDPKIVVRELTLDIPGLESHEIPKKLVDCDKLLLCDMEKGVVLW

SEQ ID NO: 3951 - protein, 2208 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 3952 - protein, 149 aa, Arabidopsis thaliana
DKPIERMKAMVTWYISTLRPLIFGLAPYNPVIGETHHVSNGHINVLAEQISHHPPVSALHATHEKENVDVLLCQYFTPKFRGAYVDVEVKGKRVVKLLNHKETYEMNQPKLLMTFLPAMGAHWAGKIVIKCPETGLGAELQLLSDSFLS

SEQ ID NO: 3953 - protein, 546 aa, Arabidopsis thaliana
MIKQIFGKLPRKPSKSLQNDSNGEGGVNNSYYASNSSTTSISKPSSTSSKSSSASGSRVANGTLAPNSMSSNRNTNQGKKPLGGDAVVQAGPFPSSGGVYEALPSFRDVPISEKPNLFIGKLSMCCVVFDFSDPSKNLKEKEIKRQTLLELVDYVASVGFKFNDVSMQELTKMVAVNLFRTFPSANHESKILEIHDMDDEEPSLEPAWPHVQVVYEILLRFVASPMTDAKLAKRYIDHSFVLKLLDLFDSEDQREREYLKTILHRVYGKFMVHRPYIRKAINNIFYRFISETEKHNGIAELLEILGSIINGFALPLKEEHKLFLLRALIPLHKPKCSSVYHQQLSYCIVQFVEKDFKLADTVIRGLLKYWPVTNSSKEVMFLGELEEVLEATQAAEFQRCMVPLSRQIARCLNSSHFQVAERALFLWNNDHIRNLITQNHKVIMPIVFPALERNTRGHWNQAVQSLTINVRKVLCEIDQVLFDECLAKFQVEEVNKTEVKAKRERTWQRLEDLATSKTVVTNEAVLVPRFVSSVNLTTSSSESTGS

SEQ ID NO: 3954 - protein, 496 aa, Arabidopsis thaliana
MELESSPPLPPHVMLVSFPGQGHVNPLLRLGKLLASKGLLITFVTTESWGKKMRISNKIQDRVLKPVGKGYLRYDFFDDGLPEDDEASRTNLTILRPHLELVGKREIKNLVKRYKEVTKQPVTCLINNPFVSWVCDVAEDLQIPCAVLWVQSCACLAAYYYYHHNLVDFPTKTEPEIDVQISGMPLLKHDEIPSFIHPSSPHSALREVIIDQIKRLHKTFSIFIDTFNSLEKDIIDHMSTLSLPGVIRPLGPLYKMAKTVAYDVVKVNISEPTDPCMEWLDSQPVSSVVYISFGTVAYLKQEQIDEIAYGVLNADVTFLWVIRQQELGFNKEKHVLPEEVKGKGKIVEWCSQEKVLSHPSVACFVTHCGWNSTMEAVSSGVPTVCFPQWGDQVTDAVYMIDVWKTGVRLSRGEAEERLVPREEVAERLREVTKGEKAIELKKNALKWKEEAEAAVARGGSSDRNLEKFVEKLGAKPVGKVQNGSHNHVLAGSIKSF

SEQ ID NO: 3955 - protein, 163 aa, Arabidopsis thaliana
LGKLLASKGLLITFVTTESWGKKMRISNKIQDRVLKPVGKGYLRYDFFDDGLPEDDEASRTNLTILRPHLELVGKREIKNLVKRYKEVTKQPVTCLINNPFVSWVCDVAEDLQIPCAVLWVQSCACLAAYYYYHHNLVDFPTKTEPEIDVQISGMPLLKHDEI

SEQ ID NO: 3956 - protein, 59 aa, Arabidopsis thaliana
ALKFLKWVVKQPGLETDHIVQLVCITTHILVRARMYDPARHILKELSLMSGKSSFVFGA

SEQ ID NO: 3957 - protein, 60 aa, Arabidopsis thaliana
KFLKWVVKQPGLETDHIVQLVCITTHILVRARMYDPARHILKELSLMSGKSSFVFGALMT

SEQ ID NO: 3958 - protein, 416 aa, Arabidopsis thaliana
MRNQGFTKEDRMNQLPEDLILRILSFLPTELVIATSVLSKQWRSLWKLVPNLEFDSDDYESEHYTFSEIVCKSFLSLKAPVLKSLHLSFRKSVNPVDIGLWIGIAFARHLRELVLYVAPKQTFTFPSSLCICNTLETLKLILGIHVDIPCPVLLKSLRTLHLDSVSYKDEESIRNLLSSCPILENLVVYEYWYNVVNFDIEVPSLKRLEICDVLHKKEFRRYTINVPCLKYLRIEGLNKDFELCLNAPELVEAYFTKGSLIIADKFLGSLKSAKRLSLDILALKMHTRREEWWNLLTVMLDSSPKLQVLKLIDHTQDVSKDNVVSEKWNEPKYVPECLLSHLETFVWIRYDWEREEEKEVATYILRNARWLKKGTISTNPIESKDLEKLEERRKMLNELDSVVRASNSCNLVFEFE

SEQ ID NO: 3959 - protein, 493 aa, Arabidopsis thaliana
MDSNCIQFLHDKTILVTGVPGFLAKVFVEKILRIQPKVKKLFLLLRAADNESAMQRFHSEVLEKDLFRVLKNALGDENLKAFITEKVVPIPGDISVDNLGVKGSDLLQHMWNEIDIIVNVAATTNFDERYDVGLSVNTFGPLNVLNFAKKCVKGQLLLHVSTAYVRGEKSGLLHEKTFHMGETLNGHRKLVIETEMELMKQKLKELQKQNCSEEEISQSMKDLGMSRAKLHGWPNTYVFTKSMGEMLLGNYRENLPIVIIRPTMITSTFSEPFPGWIEGLRTIDSVIVAYGKGRLKCFLADPNSVLDLIPVDMVANAMVTAAAIHAGKLGSQTVYHVGSSCKNPITFEQIHDLAASYFTKNPLVRRDGSSILVSKGTILSTMAQFSFYMTLRYKLPLQMLRLIYVIYPWWNGNKYKDIDRKIKLAMRLVDLYRPYVLFKGIFDDTNTEKLRLKRKEINKEMYGLFEFDPKSIDWEDYMTTIHIPGLITYVLKK

SEQ ID NO: 3960 - protein, 433 aa, Arabidopsis thaliana
MDSNCIQFLHDKTILVTGVPGFLAKVFVEKILRIQPKVKKLFLLLRAADNESAMQRFHSEVLEKDLFRVLKNALGDENLKAFITEKVVPIPGDISVDNLGVKGSDLLQHMWNEIDIIVNVAATTNFDERYDVGLSVNTFGPLNVLNFAKKCVKGQLLLHVSTAYVRGEKSGLLHEKTFHMGETLNGHRKLVIETEMELMKQKLKELQKQNCSEEEISQSMKDLGMSRAKLHGWPNTYVFTKSMGEMLLGNYRENLPIVIIRPTMITSTFSEPFPGWIEGLRTIDSVIVAYGKGRLKCFLADPNSVLDLIPVDMVANAMVTAAAIHAGKLGSQTVYHVGSSCKNPITFEQIHDLAASYFTKNPLVRRDGSSILVSKGTILSTMAQFSFYMTLRYKLPLQTLTARLSWRCGWSTSTDLMSCLRAYLTIRILRNCG

SEQ ID NO: 3961 - protein, 98 aa, Arabidopsis thaliana
TDKRLIIFLAPTVNLVKQQCCEIRALVNLKVEEYFGAKGVDKWTSQRWDEEFSKHDVLVMTPQILLDVLRSAFLKLEMVCLLIIDECHHTTGNHPYAK

SEQ ID NO: 3962 - protein, 133 aa, Arabidopsis thaliana
LIIFLAPTVNLVKQQCCEIRALVNLKVEEYFGAKGVDKWTSQRWDEEFSKHDVLVMTPQILLDVLRSAFLKLEMVCLLIIDECHHTTGNHPYAKLMKEFYHESTSKPKIFGLTASAVIRKGIVSSPSNYAAQV

SEQ ID NO: 3963 - protein, 961 aa, Arabidopsis thaliana
MTDIEALKAITTESIDLENVPVEEVFQHLKCTKEGLTSNEVQERLTLFGYNKLEEKKESKILKFLGFMWNPLSWVMEAAALMAIGLAHGGGKPADYHDFVGIVVLLLINSTISFVEENNAGNAAAALMAQLAPKAKAVRDGKWNEIDAAELVPGDIVSIKLGDIIPADARLLEGDPLKIDQATLTGESLPVTKNPGASVYSGSTCKQGEIEAVVIATGVHTFFGKAAHLVDSTTHVGHFQKVLTAIGNFCICSIAVGMAIEIVVIYGLQKRGYRVGIDNLLVLLIGGIPIAMPTVLSVTMAIGAHRLAQQGAITKRMTAIEEMAGMDVLCSDKTGTLTLNKLSVDKNLIEVFKRGIDRDMAVLMAARAARLENQDAIDTAIVSMLSDPKEARAGIKELHFLPFSPANRRTALTYLDGEGKMHRVSKGAPEEILDMAHNKLEIKEKVHATIDKFAERGLRSLGLAYQEVPDGDVKGEGGPWDFVALLPLFDPPRHDSAQTIERALHLGVSVKMITGDQLAIAKETGRRLGMGTNMYPSSSLLSDNNTEGVSVDELIENADGFAGVFPEHKYEIVKRLQSRKHICGMTGDGVNDAPALKKADIGIAVDDATDAARGASDIVLTEPGLSVIISAVLTSRAIFQRMKNYTIYAVSITIRIVMGFMLLCVFWEFDFPPFMVLVIAILNDGTIMTISKDRVKPSPTPDCWKLKEIFATGVVLGAYLAIMTVVFFWAAYETNFFHNIFHVRNFNQHHFKMKDKKVAAHLNEQMASAVYLQVSTISQALIFVTRSRSWSFVERPGFLLVIAFLIAQLVASVISAMANWPFAGIRSIGWGWTGVIWIFNIVTYMLLDPIKFLVRYALSGKSWDRMVEGRTALTGKKNFGQEERMAAWATEKRTQHGLETGQKPVYERNSATELNNMAEEAKRRAEIARMRELQTLKGKVESAAKLKGYDLEDPNSNNYTI

SEQ ID NO: 3964 - protein, 584 aa, Arabidopsis thaliana
MSKQTYKVCFCFRRRYRHTVSVAPAEIKTLFDNYSDKGLMTTDLLLRFLIDVQKQDKATKEEAQDIVNASSSLLHRNGLHLDAFFKYLFAVTNSPLSSLEVHQDMDAPLSHYFIYTGHNSYLTGNQLSSDCSELPIIEALKKGVRVIELDIWPNSDEDGIDVLHGRTLTSPVELIKCLRAIREHAFDVSDYPVVVTLEDHLTPKLQAKVAEMVTDIFGEMLFTPPSGECLKEFPSPAFLKKRIMISTKPPKEYKAATDDDLVKKGRDLGDKEVWGREVPSFIRRDRSVDKNDSNGDDDDDDDDDDDDDDGDDKIKKNAPPEYKHLIAIEAGKPKGGITECLKVDPDKVRRLSLSEEQLEKASEKYAKQIVRFTQRNLLRVYPKGTRITSSNYNPLIAWSHGAQMVAFNMQGLGRSLWVMQGMFRGNGGCGYIKKPDLLLKSNAVFDPEATLPVKTTLRVTIYMGEGWYYDFPHTHFDRYSPPDFYTRVGIAGVPADTVMKKTKTLEDNWIPAWDEVFEFPLTVPELALLRIEVHEYDMSEKDDFGGQICLPVWELRQGIRAVPLRNQDGVKCRSVKLLVRLEFV

SEQ ID NO: 3965 - protein, 1033 aa, Arabidopsis thaliana
MRDLKEYDYSALLLNLTTSSLNKAQRRWRFAYAAIYSMRAMLSLVKEIVPARIDPKTSDASLSLSYTALESGEGAKINSMPLSYVPAIDQEQLVEIMKGKDLPGIQALGGVEGVAASLRTNPTKGIHGNEQEVSRRRDLFGSNTYHKPPPKGLLFFVYEAFKDLTILILLVCAIFSLGFGIKEHGIKEGWYEGGSIFVAVFLVIVVSALSNFRQERQFDKLSKISNNIKVEVLRDSRRQHISIFDVVVGDVVFLKIGDQIPADGLFLEGHSLQVDESSMTGESDHLEVDHKDNPFLFSGTKIVDGFAQMLVVSVGMSTTWGQTMSSINQDSSERTPLQVRLDTLTSTIGKIGLTVAALVLVVLLVRYFTGNTEKEGKREYNGSKTPVDTVVNSVVRIVAAAVTIVVVAIPEGLPLAVTLTLAYSMKRMMSDQAMVRKLSACETMGSATVICTDKTGTLTLNEMKVTKFWLGQESIHEDSTKMISPDVLDLLYQGTGLNTTGSVCVSDSGSTPEFSGSPTEKALLSWTVLNLGMDMESVKQKHEVLRVETFSSAKKRSGVLVRRKSDNTVHVHWKGAAEMVLAMCSHYYTSTGSVDLMDSTAKSRIQAIIQGMAASSLRCIAFAHKIASNDSVLEEDGLTLMGIVGLKDPCRPGVSKAVETCKLAGVTIKMITGDNVFTAKAIAFECGILDHNDKDEEDAVVEGVQFRNYTDEERMQKVDKIRVMARSSPSDKLLMVKCLRLKGHVVAVTGDGTNDAPALKEADIGLSMGIQGTEVAKESSDIVILDDNFASVATVLKWGRCVYNNIQKFIQFQLTVNVAALVINFIAAISAGEVPLTAVQLLWVNLIMDTLGALALATERPTNELLKRKPVGRTEALITNVMWRNLLVQSLYQIAVLLILQFKGMSIFSVRKEVKDTLIFNTFVLCQVFNEFNAREMEKKNVFKGLHRNRLFIGIIAITIVLQVIMVEFLKKFADTVRLNGWQWGTCIALASLSWPIGFFTKFIPVSETPFLSYFKNPRSLFKGSRSPSLKKP

SEQ ID NO: 3966 - protein, 734 aa, Arabidopsis thaliana
MAEQKSSNGGGGGGDVVINVPVEEASRRSKEMASPESEKGVPFSKSPSPEISKLVGSPNKPPRAPNQNNVGLTQRKSFARSVYSKPKSRFVDPSCPVDTSILEEEVREQLGAGFSFSRASPNNKSNRSVGSPAPVTPSKVVVEKDEDEEIYKKVKLNREMRSKISTLALIESAFFVVILSALVASLTINVLKHHTFWGLEVWKWCVLVMVIFSGMLVTNWFMRLIVFLIETNFLLRRKVLYFVHGLKKSVQVFIWLCLILVAWILLFNHDVKRSPAATKVLKCITRTLISILTGAFFWLVKTLLLKILAANFNVNNFFDRIQDSVFHQYVLQTLSGLPLMEEAERVGREPSTGHLSFATVVKKGTVKEKKVIDMGKVHKMKREKVSAWTMRVLMEAVRTSGLSTISDTLDETAYGEGKEQADREITSEMEALAAAYHVFRNVAQPFFNYIEEEDLLRFMIKEEVDLVFPLFDGAAETGRITRKAFTEWVVKVYTSRRALAHSLNDTKTAVKQLNKLVTAILMVVTVVIWLLLLEVATTKVLLFFSTQLVALAFIIGSTCKNLFESIVFVFVMHPYDVGDRCVVDGVAMLVEEMNLLTTVFLKLNNEKVYYPNAVLATKPISNYFRSPNMGETVEFSISFSTPVSKIAHLKERIAEYLEQNPQHWAPVHSVVVKEIENMNKLKMALYSDHTITFQENRERNLRRTELSLAIKRMLEDLHIDYTLLPQDINLTKKN

SEQ ID NO: 3967 - protein, 173 aa, Arabidopsis thaliana
MVIFSGMLVTNWFMRLIVFLIETNFLLRRKVLYFVHGLKKSVQVFIWLCLILVAWILLFNHDVKRSPAATKVLKCITRTLISILTGAFFWLVKTLLLKILAANFNVNNFFDRIQDSVFHQYVLQTLSGLPLMEEAERVGREPSTGHLSFATVVKKGTVKEKKVIDMGKVHKMK

SEQ ID NO: 3968 - protein, 196 aa, Arabidopsis thaliana
LYFVHGLKKSVQVFIWLCLILVAWILLFNHDVKRSPAATKVLKCITRTLISILTGAFFWLVKTLLLKILAANFNVNNFFDRIQDSVFHQYVLQTLSGLPLMEEAERVGREPSTGHLSFATVVKKGTVKEKKVIDMGKVHKMKREKVSAWTMRVLMEAVRTSGLSTISDTLDETAYGEGKEQADREITSEMEALAAA

SEQ ID NO: 3969 - protein, 306 aa, Arabidopsis thaliana
MKQRRRRNGCSSSNTISLLLLFFLVFFSRTSTSTSCRRRTVKHLSTTSTSSTPLESRITSKVIVISIVSGILTGLVSALVLAFLVRSIVKFMKQTPILKGPVVFSPKITPKSLHAALSNVKRLGSLEGVGSPESSSSKSVKRRLQKELELLAGLRHRNLMSLRAYVRESDEFSLVYDYMPNGSLEDVMNKVRTKEVELGWEIRLRVAVGIVKGLQYLHFSCETQILHYNLKPTNVMLDSEFEPRLADCGLAKIMPSSHTAVSCYSAPESSQSNRQKRHIQLWDDIGCSFNRKRPDPPVLRRVCKRR

SEQ ID NO: 3970 - protein, 811 aa, Arabidopsis thaliana
MADIIGGEVVTELVRQLYAVSQKTLRCRGIAKNLATMIDGLQPTIKEIQYSGVELTPHRQAQLRMFSETLDKCRKLTEKVLKSSRWNMVRQLLHVRKMENLQSKVSSFLNGQLLVHVLADVHHVRADSEFRFDRIDRKVDSLNEKLGSMKLRGSESLREALKTAEATVEMVTTDGADLGVGLDLGKRKVKEMLFKSIDGERLIGISGMSGSGKTTLAKELARDEEVRGHFGNKVLFLTVSQSPNLEELRAHIWGFLTSYEAGVGATLPESRKLVILDDVWTRESLDQLMFENIPGTTTLVVSRSKLADSRVTYDVELLNEHEATALFCLSVFNQKLVPSGFSQSLVKQVVGECKGLPLSLKVIGASLKERPEKYWEGAVERLSRGEPADETHESRVFAQIEATLENLDPKTRDCFLVLGAFPEDKKIPLDVLINVLVELHDLEDATAFAVIVDLANRNLLTLVKDPRFGHMYTSYYDIFVTQHDVLRDVALRLSNHGKVNNRERLLMPKRESMLPREWERNNDEPYKARVVSIHTGEMTQMDWFDMELPKAEVLILHFSSDKYVLPPFIAKMGKLTALVIINNGMSPARLHDFSIFTNLAKLKSLWLQRVHVPELSSSTVPLQNLHKLSLIFCKINTSLDQTELDIAQIFPKLSDLTIDHCDDLLELPSTICGITSLNSISITNCPRIKELPKNLSKLKALQLLRLYACHELNSLPVEICELPRLKYVDISQCVSLSSLPEKIGKVKTLEKIDTRECSLSSIPNSVVLLTSLRHVICDREALWMWEKVQKAVAGLRVEAAEKSFSRDWLDD

SEQ ID NO: 3971 - protein, 328 aa, Arabidopsis thaliana
MAVTEEEKKRNSTVEISGLRFTYPGIDGHPPPGSKPLIEDFSITLNSSDRCLLVGSNGAGKTTILKILGGKHMVEPHMVRVLGRSAFHDTGLTSSGDLCYLGGEWRRDVAFAGFEVPIQMDISAEKMIFGVAGIDPQRRDELIKVLDIDISWRLHKVSDGQRRRVQICMGLLKPFKVLLLDEITVDLDVLARADLLKFLRKECEERGATIIYATHIFDGLEDWPTHIVYVANGKLQLALPMEKVKETSKKSLMRTVESWLRKERDEERKRRKERKANGLPEFETRTEESRVTGDPARMLNNGWAAGRLHSTVAGGEDNFVLSSNRVLR

SEQ ID NO: 3972 - protein, 437 aa, Arabidopsis thaliana
MDRISNLPDGVIYRVISLLSTKEATCLKYTSKNWLNLVTIIPIAVFVDSSASAISASFKDFADRIMLARLASHRIRRFSLKLQSLNFAQYKTVNDCLRNVLECGVLDLELDINVRGDYSLPSEIFTCKSVVKMKLGSGFVIDILPKNAWLPALKTLLLDTVRFEFDNTAGCSFTKLISACPVLEELVIDGHNCEDWKWSRRVSSQILKRLTIRRKEWVHDGSSFEPISLDIPSLEYFKYFDTLRDSYPVVKLNSLVEAKLELPSLYIGDTYNVRNLIKGLKNVQILRLGAVDTMHLFWVFREAVPVFENLFHLSVSTHDAICWDDLRILLEKSPNLKTLTIEALHYHGYGDENSVCECLDGYSFLLSCPIEILKITEFGGEIEEMEQVEYVLENLLCLVLLEIHVKTKKIDRKLQILADLLMLPRASSKCKVQVKFV

SEQ ID NO: 3973 - protein, 186 aa, Arabidopsis thaliana
EDMDLAVRASLKGWKFLYLGSLKVKNELPSTFKAYRYQQHRWSCGPANLFRKMAFEIMTNKNVTLWKKVHVIYSFFVVRKLVAHIVTFIFYCVILPATVLVPEVTVPKWGAVYIPSVITLLNAVGTPRSLHLMVFWILFENVMSLHRTKATFIGLLEGGRVNEWIVTEKLGDVKAKSATKTSKKVI

SEQ ID NO: 3974 - protein, 46 aa, Arabidopsis thaliana
HLMVFWILFENVMSLHRTKATFIGLLEGGRVNEWIVTEKLGDVKAK

SEQ ID NO: 3975 - protein, 63 aa, Arabidopsis thaliana
LLITFDSFLHQNYSKTTYLPTFTKVLLLVGIVVVCRPIFNWIVKRTPEGKKLKASHLCTICVM

SEQ ID NO: 3976 - protein, 67 aa, Arabidopsis thaliana
DSFLHQNYSKTTYLPTFTKVLLLVGIVVVCRPIFNWIVKRTPEGKKLKASHLCTICVMLCTATFLSE

SEQ ID NO: 3977 - protein, 442 aa, Arabidopsis thaliana
MEPKFHAFMFPWFAFGHMIPFLHLANKLAEKGHRVTFLLPKKAQKQLEHHNLFPDSIVFHPLTVPPVNGLPAGAETTSDIPISLDNLLSKALDLTRDQVEAAVRALRPDLIFFDFAQWIPDMAKEHMIKSVSYIIVSATTIAHTHVPGGKLGVRPPGYPSSKVMFRENDVHALATLSIFYKRLYHQITTGLKSCDVIALRTCKEVEGMFCDFISRQYHKKVLLTGPMFPEPDTSKPLEERWNHFLSGFAPKSVVFCSPGSQVILEKDQFQELCLGMELTGLPFLLAVKPPRGSSTVQEGLPEGFEERVKDRGVVWGGWVQQPLILAHPSIGCFVNHCGPGTIWESLVSDCQMVLIPFLSDQVLFTRLMTEEFEVSVEVPREKTGWFSKESLSNAIKSVMDKDSDIGKLVRSNHTKLKEILVSPGLLTGYVDHFVEGLQENLI

SEQ ID NO: 3978 - protein, 417 aa, Arabidopsis thaliana
MEPKFHAFMFPWFAFGHMIPFLHLANKLAEKGHRVTFLLPKKAQKQLEHHNLFPDSIVFHPLTVPPVNGLPAGAETTSDIPISLDNLLSKALDLTRDQVEAAVRALRPDLIFFDFAQWIPDMAKEHMIKSVSYIIVSATTIAHTHVPGGKLGVRPPGYPSSKVMFRENDVHALATLSIFYKRLYHQITTGLKSCDVIALRTCKEVEDTSKPLEERWNHFLSGFAPKSVVFCSPGSQVILEKDQFQELCLGMELTGLPFLLAVKPPRGSSTVQEGLPEGFEERVKDRGVVWGGWVQQPLILAHPSIGCFVNHCGPGTIWESLVSDCQMVLIPFLSDQVLFTRLMTEEFEVSVEVPREKTGWFSKESLSNAIKSVMDKDSDIGKLVRSNHTKLKEILVSPGLLTGYVDHFVEGLQENLI

SEQ ID NO: 3979 - protein, 123 aa, Arabidopsis thaliana
KDDDSVTPDPKEEDDISYCSLCDLEVKRSSKHCRTCNRCVEGFDHHCRWLNNCVGKKNYTTFILLMVFVLLMLIIEGGTALAVFVRCFVDKKGMEMELKRRLYVEFPQWALATISIILVLFTA

SEQ ID NO: 3980 - protein, 48 aa, Arabidopsis thaliana
HHCRWLNNCVGKKNYTTFILLMVFVLLMLIIEGGTALAVFVRCFVDKK

SEQ ID NO: 3981 - protein, 59 aa, Arabidopsis thaliana
KLGPHFKVSAGSMQVIALVSGCVFIILNNWTTYPMYQKLIRKPLTPLQKVGIGHVLTIL

SEQ ID NO: 3982 - protein, 70 aa, Arabidopsis thaliana
TYPMYQKLIRKPLTPLQKVGIGHVLTILSMAISAVVEAKRLKTVENSHLMSVLWLVPALVINGIGEAFHF

SEQ ID NO: 3983 - protein, 175 aa, Arabidopsis thaliana
EEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWLVFPMYKKLTHKLLTPLQKVGIGQVLTILSMALSAVVEAKRLKTVENGH

SEQ ID NO: 3984 - protein, 27 aa, Arabidopsis thaliana
VIIMNNWLVFPMYKKLTHKLLTPLQKV

SEQ ID NO: 3985 - protein, 237 aa, Arabidopsis thaliana
MGRIGLVVTDLVLSFMWIWAGVLVNILVHGVLGFSRTDPSGEIVRYLFSIISMFIFAYLQQATKGGLYNPLTALAAGVSGGFSSFIFSVFVRIPVEVIGSILAVKHIIHVFPEIGKGPKLNVAIHHGALTEGILTFFIVLLSMGLTRKIPGSFFMKTWIGSLAKLTLHILGSDLTGGCMNPAAVMGWAYARGEHITKEHLLVYWLGPVKATLLAVWFFKVVFKPLTEEQEKPKAKSE

SEQ ID NO: 3986 - protein, 393 aa, Arabidopsis thaliana
MELGKSMENQTDVMVLLAKHVIPTVANGSNLVFSPMSINVLLCLIAAGSNCVTKEQILSFIMLPSSDYLNAVLAKTVSVALNDGMERSDLHLSTAYGVWIDKSLSFKPSFKDLLENSYNATCNQVDFATKPAEVINEVNAWAEVHTNGLIKEILSDDSIKTIRESMLILANAVYFKGAWSKKFDAKLTKSYDFHLLDGTMVKVPFMTNYKKQYLEYYDGFKVLRLPYVEDQRQFAMYIYLPNDRDGLPTLLEEISSKPRFLDNHIPRQRILTEAFKIPKFKFSFEFKASDVLKEMGLTLPFTHGSLTEMVESPSIPENLCVAENLFVSNVFHKACIEVDEEGTEAAAVSVASMTKDMLLMGDFVADHPFLFTVREEKSGVILFMGQVLDPSIH

SEQ ID NO: 3987 - protein, 198 aa, Arabidopsis thaliana
MESNNNNLNLDMEKDQETTFDYSKRAQWLRAAVLGANDGLVSTASLMMGIGAVKQDVRIMLLTGFAGLVAGACSMAIGEFISVYSQYDIEVAQMKRESGGETKKEKLPSPTQAAIASALAFTLGAIVPLLAAAFVKEYKVRIGVIVAAVTLALVMFGWLGAVLGKAPVVKSLVRVLIGGWLAMAITFGFTKLVGSHGL

SEQ ID NO: 3988 - protein, 315 aa, Arabidopsis thaliana
MADEIGFFQLNTGAKIPSVGLGTWQAAPGVVGDAVAAAVKIGYQHIDCASRYGNEIEIGKVLKKLFDDGVVKREKLFITSKIWLTDLDPPDVQDALNRTLQDLQLDYVDLYLMHWPVRLKKGTVDFKPENIMPIDIPSTWKAMEALVDSGKARAIGVSNFSTKKLSDLVEAARVPPAVNQVECHPSWQQHKLHEFCKSKGIHLSGYSPLGSPGTTWVKADVLKSPVIEMIAKEIGKSPAQTALRWGLQMGHSILPKSTNEGRIRENFDVLGWSIPKEMFDKFSKIEQARLVQGTSFVHETLSPYKTLEELWDGEI

SEQ ID NO: 3989 - protein, 395 aa, Picea mariana
MAGGLMADLEAFRKAQRADGPATILAIGTATPPNAVDQSTYPDYYFKITNSEHMTELKEKFQRMCDKSAIKKRYMYLTDEILKENPNVCEYMAPSLDARQDMVVVEVPRLGKEAATKAIKEWGQPKSKITHVIFCTTSGVDMPGADYQLTKLLGLRPSVKRVMMYQQGCFAGGTVLRVAKDLAENNRGARVLVVCSEITAVTFRGPSDTHLDSMVGQALFGDGAAALIVGADPIPQVEKPCFELMWTAQTILPDSDGAIDGHLREVGLTFHLLKDVPGLISKNIEKSLVEAFQQFGISDWNQLFWIAHPGGPAILDQVEAKLNLDPKKLRATRQVLSEYGNMSSACVHFILDEMRKSSNEKGCSTTGEGLDVGVLFGFGPGLTVETVVLKSVPLQ

SEQ ID NO: 3990 - protein, 90 aa, Taxus cuspidata
EVVSALAWIARTRALQIPHSENVKLIFAMDMRKLFNPPLSKGYYGNFVGTVCAMDNVKDLLSGSLLRVVRIIKKAKVSLNEHFTSTIVTP

SEQ ID NO: 3991 - protein, 84 aa, Taxus cuspidata
LAWIARTRALQIPHSENVKLIFAMDMRKLFNPPLSKGYYGNFVGTVCAMDNVKDLLSGSLLRVVRIIKKAKVSLNEHFTSTIVT

SEQ ID NO: 3992 - protein, 145 aa, Prunus persica
PKLFTKFAQTQSLATRNSGGSGLGLAICKRFVNLMEGHIWIESEGPGKGCTAIFIVKLGFAERSNESKLPFLTKVQANHVQTNFPGLKVLVMDDNGSVTKGLLVHLGCDVTTVSSIDEFLHVISQEHKVVFMDVCMPGIDGYELA

SEQ ID NO: 3993 - protein, 70 aa, Prunus persica
IWIESEGPGKGCTAIFIVKLGFAERSNESKLPFLTKVQANHVQTNFPGLKVLVMDDNGSVTKGLLVHLGC

SEQ ID NO: 3994 - protein, 271 aa, Arabidopsis thaliana
MADNDSLDQFLAAAIDAAKKAGQIIRKGFYETKHVEHKGQVDLVTETDKGCEELVFNHLKQLFPNHKFIGEETTAAFGVTELTDEPTWIVDPLDGTTNFVHGFPFVCVSIGLTIGKVPVVGVVYNPIMEELFTGVQGKGAFLNGKRIKVSAQSELLTALLVTEAGTKRDKATLDDTTNRINSLLTKVRSLRMSGSCALDLCGVACGRVDIFYELGFGGPWDIAAGIVIVKEAGGLIFDPSGKDLDITSQRIAASNASLKELFAEALRLTGA

SEQ ID NO: 3995 - protein, 469 aa, Arabidopsis thaliana
MAATTENLPQLKSAVDGLTEMSESEKSGFISLVSRYLSGEAQHIEWSKIQTPTDEIVVPYEKMTPVSQDVAETKNLLDKLVVLKLNGGLGTTMGCTGPKSVIEVRDGLTFLDLIVIQIENLNNKYGCKVPLVLMNSFNTHDDTHKIVEKYTNSNVDIHTFNQSKYPRVVADEFVPWPSKGKTDKEGWYPPGHGDVFPALMNSGKLDTFLSQGKEYVFVANSDNLGAIVDLTILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKASSDLLLVQSDLYTLVDGFVTRNKARTNPSNPSIELGPEFKKVATFLSRFKSIPSIVELDSLKVSGDVWFGSSIVLKGKVTVAAKSGVKLEIPDRAVVENKNINGPEDL

SEQ ID NO: 3996 - protein, 595 aa, Arabidopsis thaliana
MDLCFQNPVKCGDRLFSALNTSTYYKLGTSNLGFNGPVLENRKKKKKLPRMVTVKSVSSSVVASTVQGTKRDGGESLYDAIVIGSGIGGLVAATQLAVKEARVLVLEKYLIPGGSSGFYERDGYTFDVGSSVMFGFSDKGNLNLITQALKAVGRKMEVIPDPTTVHFHLPNNLSVRIHREYDDFIAELTSKFPHEKEGILGFYGDCWKIFNSLNSLELKSLEEPIYLFGQFFQKPLECLTLAYYLPQNAGAIARKYIKDPQLLSFIDAECFIVSTVNALQTPMINASMVLCDRHYGGINYPVGGVGGIAKSLAEGLVDQGSEIQYKANVKSIILDHGKAVGVRLADGREFFAKTIISNATRWDTFGKLLKGEKLPKEEENFQKVYVKAPSFLSIHMGVKAEVLPPDTDCHHFVLEDDWKNLEEPYGSIFLSIPTILDSSLAPDGRHILHIFTTSSIEDWEGLPPKEYEAKKEDVAARIIQRLEKKLFPGLSSSITFKEVGTPRTHRRFLARDKGTYGPMPRGTPKGLLGMPFNTTAIDGLYCVGDSCFPGQGVIAVAFSGVMCAHRVAADIGLEKKSRVLDVGLLGLLGWLRTLA

SEQ ID NO: 3997 - protein, 177 aa, Oryza sativa
MESCPSVKNILLLDSEGKRVAVKYYTDDWPTLSAKLAFEKSVFVKTQKATAGAEAEIVMFDGHIVVYKFIQDLHFFVTGGEEENELILASVLQGFTDAVDIILRNNVDKRTALENLDLILLCLDEIVDGGIVLETEGSVIAEKVSAHGIEGATSLAEQTIVQALTTAREHLTKSLLM

SEQ ID NO: 3998 - protein, 393 aa, Ipomoea batatas
MVTVEEVRKAQRAEGPATILAIGTVTPANCVNQSTYPDYYFRITNSEHKTELKEKFQRMCDKSMITKRYMHLTEEILKENPSFCEYMAPSLDARQDIAVVEVPKLGKEAAQSAIKEWGQPKSKITHVVFCTTSGIDMPGADYQLTKLLGLRPSVKRLMMYQQGCFAGGTVLRLAKDLAENNKGARVLIVCSEITVVTFRGPSETHLDSLVGQALFGDGAAAVIVGADPTPAEKPLFQLVSAAQTLAPNSCGAIDGHLREVGLTFHLLKDVPSVVSNKIEKCLFEAFNPLGISDWNSVFWIAHPGGPAILDQVEDKLGLKPEKLRATRHVLSEYGNMSSACVLFILDEMRKASSNAGLGTTGEGLEWGVLFGFGPGLTIETVVLHSVPIKPGPH

SEQ ID NO: 3999 - protein, 388 aa, Ipomoea batatas
MVTVEEVRKAQRAEGPATILAIGTVTPANCVNQSTYPDYYFRITNSEHKTELKEKFQRMCDKSMITKRYMHLTEEILKENPSFCEYMAPSLDARQDIAVVEVPKLGKEAAQSAIKEWGQPKSKITHVVFCTTSGIDMPGADYQLTKLLGLRPSVKRLMMYQQGCFAGGTVLRLAKDLAENNKGARVLIVCSEITVVTFRGPSETHLDSLVGQALFGDGAAAVIVGADPTPAEKPLFQLVSAAQTLAPNSCGAIDGHLREVGLTFHLLKDVPSVVSNNIEKCLFEAFNPLGISDWNSVFWIAHPGGPAILDQVEDKLGLKPEKLRATRHVLSEYGNMSSACVLFILDEMRKASSNAGLGTTGEGLEWGVLFGFGPGLTIETVVLHSVPT

SEQ ID NO: 4000 - protein, 393 aa, Ipomoea batatas
MVTVEEVRKAKRAEGPATILAIGTATPANCVNQSTYPDYYFRITNSEHKTELKEKFQRMCDKSMITKRYMHLTEEILKENPSFCEYMAPSLDARQDIAVVEVPKLGKEAAQSAIKEWGQPKSKITHVFFCTTSGVDMPGADYQLTKLLGLRPSVKRLMMYQQGCFAGGTVLRLAKDLAENNKGARVLIVCSEITVVTFRGPSETHLDSLVGQALFGDGAAAVIVGADPTPAEKPLFQLVSAAQTLAPDSCGAIDGHLREVGLTFHLLKDVPSVVSNNIEKCLFEAFNPLGISDWNSVFWIAHPGGPAILDQVEDKLGLKPEKLRATRHVLSEYGNMSSACVLFILDEMRKASSNAGLGTTGEGLEWGVLFGFGPGLTIETVVLHSVPIKPGPH

SEQ ID NO: 4001 - protein, 393 aa, Ipomoea batatas
MVTVEEVRKAQRAEGPATILAIGTATPANCVNQSTYPDYYFRITNSEHKTELKEKFQRMCDKSMITKRYMHLTEEILKENPSFCEYMAPSLDARQDIAVVEVPKLGKEAAQSAIKEWGQPKSKITHVVFCTTSGVDMPGADYQLTKLLGLRPSVKRLMMYQQGCFAGGTVLRLAKDLAENNKGARVLIVCSEITVVTFRGPSETHLDSLVGQALFGDGAAAVIVGADPTPAEKPLFQLVSAAQTLAPNSCGAIDGHLREVGLTFHLLKDVPSVVSNNIEKCLFEAFNPLGISDWNSVFWIAHPGGPAILDQVEDKLGLKPEKLRATRHVLSEYGNMSSACVLFILDEMRKASSNAGLGTTGEGLEWGVLFGFGPGLTIETVVLHSVLIKPGPH

SEQ ID NO: 4002 - protein, 393 aa, Ipomoea batatas
MVTVEEVRKAQRAEGPATILAIGTVTPANCVNQSTYPDYYFRITNSEHKTELKERFQRMCDKSMITKRYMHLTEEILKENPSFCEYMAPSLDARQDIAVVEVPKLGKEAAQSAIKEWGQPKSKITHVVFCTTSGVDMPGADYQLTKLLGLRPSVKRLMMYQQGCFAGGTVLRLAKDLAENNKGARVLIVCSEITVVTFRGPSETHLDSLVGQALFGDGAAAVIVGADPTPAEKPLFQLVSAAQNLAPDSCGAIDGHLREVGLTFHLLKDVPSVVSNNIEKCLFEAFNPLGISDWNSVFWIAHPGGPAILDQVEDKLGLKPEKLRATRHVLSEYGNMSSACVLFILDEMRKASSNAGLGTTGEGLEWGVLFGFGPGLTIETVVLHSVPIKPGPH

SEQ ID NO: 4003 - protein, 388 aa, Ipomoea batatas
MVTVGEVRKAQRAEGPATILAIGTATPANCVNQSTYPDYYFRITNSEHKTELKEKFQRMCDKSMITKRYMHLTEEILKENPSFCEYMAPSLDARQDIAVVEVPKLGKEAAQSAIKGWGQPKSKITHVVFCTTSGVDMPGADYQLTKLLGLRPSVKRLMMYQQGCFAGGTVLRLAKDLAENNKGARVLIVCSEITVVTFRGPSEAHLDSLVGQALFGDGAAAVIVGADPTPAEKPLFQLVSAAQTLAPDSCGAIDGHLREVGLTFHLLKDVPSVVSNNIEKCLFEAFNPLGISDWNSVFWIAHPGGPAILDQVEDKLGLKPEKLRATRHVLSEYGNMSSACVLFILDEMRKASSNDGLGTTGEGLEWGVLFGFGPGLTIETVVLHSVPT

SEQ ID NO: 4004 - protein, 393 aa, Ipomoea batatas
MVTVEEVRKAQRAEGPATILAIGTVTPANCVNQSTYPDYYFRITNSEHKTELKEKFQRMCDKSMITKRYMHLTEEILKENPSFCEYMAPSLDARQDIAVVEVPKLGKEAAQSAIKEWGQPKSKITHVVFCTTSGVDMPGADYQLTKLLGLSPSVKRLMMYQQGCFAGGTVLRLAKDLAENNKGARVLIVCSEITVVTFRGPSETHLDSLVGQALFGDGAAAVIVGADPTPAEKPLFQLVSAAQTLAPDSCGAIDGHLREVGLTFHLLKDVPSVVSNNIEKCLFEAFNPLGISDWNSVFWIAHPGGPAILDQVEDKLGLKPEKLRATRHVLSEYGNMSSACVLFILDEMRKASSNAGLGTTGEGLEWGVLFGFGPGLTIETVVLHSVPIKPGPH

SEQ ID NO: 4005 - protein, 511 aa, Citrus unshiu
MGTESLVHVLLVSFPGHGHVNPLLRLGRLLASKGFFLTLTTPESFGKQMRKAGNFTYEPTPVGDGFIRFEFFEDGWDEDDPRREDLDQYMAQLELIGKQVIPKIIKKSAEEYRPVSCLINNPFIPWVSDVAESLGLPSAMLWVQSCACFAAYYHYFHGLVPFPSEKEPEIDVQLPCMPLLKHDEMPSFLHPSTPYPFLRRAILGQYENLGKPFCILLDTFYELEKEIIDYMAKICPIKPVGPLFKNPKAPTLTVRDDCMKPDECIDWLDKKPPSSVVYISFGTVVYLKQEQVEEIGYALLNSGISFLWVMKPPPEDSGVKIVDLPDGFLEKVGDKGKVVQWSPQEKVLAHPSVACFVTHCGWNSTMESLASGVPVITFPQWGDQVTDAMYLCDVFKTGLRLCRGEAENRIISRDEVEKCLLEATAGPKAVALEENALKWKKEAEEAVADGGSSDRNIQAFVDEVRRTSVEIITSSKSKSIHRVKELVEKTATATANDKVELVESRRTRVQY

SEQ ID NO: 4006 - protein, 405 aa, Equisetum arvense
MTVLEESADASSRRLAQRANGPATVLAIGTANPANVFEQSSYPDFYFDITNSQHMTELKLKFSRMCQKSGIKKRYMHLNSEILKANPSLCAYWEKSLDVRQDIAVVEVPKLGKEASLKAIKEWGQPKSKITHLVFCTTSGVDMPGADWALTKLLGLRPSVKRLMMYQQGCFAGGTVLRVAKDVAENNKGARVLVVCSEITCVTFRGPSETHLDSLVGQALFGDGAAAVILGSDPLPEENPCFELHWSGSNILPDSDGAIDGHLREVGLTFHLMKDVPGIISKNIGKVLNDAFRSAFDESGNAEDRPASVNDIFWIAHPGGPAILDQVEEKMKLAPEKMRATRDVLSEYGNMSSACVLFIMDHMRRMSAQNKLQTTGEGLDWGVLLGFGPGLTVETVLLKSIRLAC

SEQ ID NO: 4007 - protein, 389 aa, Bos taurus
MSRVFKKTCSNGKLSIYLGKRDFVDHVDMVEPIDGVVLVDPEYLKGRKMFVMLTCAFRYGHDDLDVIGLTFRKDLYVQVQQVVPAESSSPRGSLTVLQERLLHKLGDNAYPFTLQMVVNLPCSVTLQPGPDDTGKACGVDFEVKSFCAENLEEKVSKRDSVRLVIRKIQFAPLEPGPGPWARLCRRFLLSAQPLLLQAWMDKEVNYHGQPISVNVSINNSTNKVIKKIKISVDQITDVVLYSLDKYTKTVFVQEFTETIAANSTFSKSFAVTPLLADNCHKQGLALDGKLKQGDTNLASSTILRPGVDKELLGILVSYKVRVNLMVSCEGILGDLTASEVGVELPLILMHPKPSNEAASSEDIVIEEFAQQEPSGESQEALAAEGNEGS

SEQ ID NO: 4008 - protein, 339 aa, Oryctolagus cuniculus
MTDRSPFETDMLTLTRYVMEKGRQAKGTGELTQLLNSMLTAIKAISSAVRKAGLAHLYGIAGTVNVTGDEVKKLDVLSNALVINMLQSSYSTCVLVSEENKEAIITAKERRGKYVVCFDPLDGSSNIDCLASIGTIFAIYRKTTEDEPSDKDALQPGRNIVAAGYALYGSATLVALSTGQGVDLFMLDPALGEFVLVEKDVKIKKKGKIFSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPESIHQRVPLILGSPDDVQEYLACVQKNQAGR

SEQ ID NO: 4009 - protein, 58 aa, Oryctolagus cuniculus
LQAAGKSPEDLMKLLPHKVFEGNRPTNSIVFTKLTPFILGALIAMYEHKIFVQGVVWD

SEQ ID NO: 4010 - protein, 47 aa, Oryctolagus cuniculus
LMKLLPHKVFEGNRPTNSIVFTKLTPFILGALIAMYEHKIFVQGVVW

SEQ ID NO: 4011 - protein, 68 aa, Ovis aries
NIAMTAGWLVLAIAMVRFYMEKGTHKGLYKSIQKTLKFFQTFALLEIVHCLIGIVPTSVLVAGVQVSS

SEQ ID NO: 4012 - protein, 54 aa, Ovis aries
WLVLAIAMVRFYMEKGTHKGLYKSIQKTLKFFQTFALLEIVHCLIGIVPTSVLV

SEQ ID NO: 4013 - protein, 113 aa, Pan troglodytes
KIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKV

SEQ ID NO: 4014 - protein, 129 aa, Pan troglodytes
  MOD_RES (119)..(119): Any amino acid
LKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDXAAKSYIQSLP

SEQ ID NO: 4015 - protein, 388 aa, Caenorhabditis elegans
MTTTEEAPKSPLFEAIDKNDTEAALALLKTKEQAAQRDPSGMSVLAAAAYRGNLTLVEKAIELKCDVNDKTDGTLYTPLMFAALSGKQDVCRLLMDSGARMYLVNGIGKTASELAAFVGHHECVAIINNHITIDVIEDLLRPKVNGKYEGAEEYPDELAVFIHSLCGSHEIHPVKIIFRFSKYPDSLKYKKKILYVIDRVFEKQLRCKESNEIMSLKLWLILFSMRETSKFVESNKEKSPEEASLQYAKLISTWQEGDETRRALDVMLRNAVASFPYKHSLLHDTLQKALQKSQIGERPSAYEYIVQALFGQRIAAVCQFCSVCGHPGAKKRCTQCKLAYCSQECQKFDWPIHKKVCSFLKTRQEVSPTDETAMSLDDIQAQIAKIDV

SEQ ID NO: 4016 - protein, 486 aa, Drosophila melanogaster
MRKSTRLLTHSLFGPVFKILFHNKTVCGGCNRKMPSLVNTEIEAAVKGFLIDQEKMTEVVERMTKEIKMGLAKDTHARAVIKCFVSHVQDLPTGKERGKYLALDLGGSNFRVLLVNLISNSDVETMSKGYNFPQTLMSGSGKALFDFLAECLSEFCHSHGLENESLALGFTFSFPLQQQGLSKGILVAWTKGFSCEGVVGKNVVSLLQEAIDRRGDLKINTVAILNDTVGTLMSCAFYHPNCRIGLIVGTGSNACYVEKTVNAECFEGYQTSPKPSMIINCEWGAFGDNGVLEFVRTSYDKAVDKVTPNPGKQTFEKCISGMYMGELVRLVITDMIAKGFMFHGIISEKIQERWSFKTAYISDVESDAPGEYRNCNKVLSELGILGCQEPDKEALRYICEAVSSRSAKLCACGLVTIINKMNINEVAIGIDGSVYRFHPKYHDMLQYHMKKLLKPGVKFELVVSEDGSGRGAALVAATAVQAKSKL

SEQ ID NO: 4017 - protein, 280 aa, Schizosaccharomyces pombe
MSNPESLKKQVEPPGYNELFMVEDVCNVDLEQGLDLCKPEKVNKQSQRSRQSRQSLFTNTIKPQKDKMNIKTNKIKEFLNDPFTEFSKFHNSYYPDGRISTRSNFRWPLLIIWSIIIVFAVDKKFEVQKFLSIWINENRFYSEIWVPIAIYVCLLVLMLLSLIFFAEFAVLALRVTGVIIAVLGAVLGMIIAVLGMIIAALGMIIAALGATITGLLYFGHWALYKLVILSLGFKIVTPGDVCVSNTLPTHNGETALHSETTVGSDIEQIELQNMPTPVKK

SEQ ID NO: 4018 - protein, 45 aa, Schizosaccharomyces pombe; identical to SEQ ID NO: 3867

SEQ ID NO: 4019 - protein, 52 aa, Schizosaccharomyces pombe; identical to SEQ ID NO: 3868

SEQ ID NO: 4020 - protein, 450 aa, Magnaporthe oryzae
MATKSVLMLGSGFVTRPTLDVLTDSGIKVTVACRTLESAKKLSAGVQHSTPISLDVNDDAALDAEVAKHDLVISLIPYTFHATVIKSAIRQKKHVVTTSYVSPAMMELDQAAKDAGITVMNEIGLDPGIDHLYAIKTIEEVHAAGGKIKTFLSYCGGLPAPESSDNPLGYKFSWSSRGVLLALRNAASFYKDGKVTNVAGPELMATAKPYFIYPGFAFVAYPNRDSTPYKERYQIPEADNIVRGTLRYQGFPQFIKVLVDIGFLSDEEQPFLKEAIPWKEATQKIVKASSASEQDIVSTIVSNATFESTEEQKRIVAGLKWLGIFSDKKITPRGNALDTLCATLEEKMQFEEGERDLVMLQHKFEIENKDGSRETRTSSLCEYGAPIGSGGYSAMAKLVGVPCAVAVKFVLDGTISDRGVLAPMNSKINDPLMKELKEKYGIECKEKVVA

SEQ ID NO: 4021 - protein, 370 aa, Schizosaccharomyces pombe
MRGARAVIDLRAIGYNYNLIRELLDEKNPDAHILCILKANAYGHGAVEVAQFLAKYCSAEGFGVASIEEALELRLSGIQNRILLLEGFFTDEDELSLIDKYNFSITIHCEEQLKSFMNYPFKKPVEVHLKLDSGMNRLGFTPAEYADKYRLLKNHKNVSGIVKATHFAFADIPEKSEYTLKQWRIFEKAAGCLPDPLSAGGGVIVVGWLNTIHMDWLRTGSMLYGLDPYDLDAKAPELPKPLIPAMKLMSTIVCVKHVEKDQPIGYGGAYVTTRDSLIGVVAIGYGDGFPQVRNGCPVIINGKRVPTVGKVCMDMLAIDVTDVPDVKRGDDVVLWGNPELTIEEVSTFSNENPFEIITGLTRRVPLQYTF

SEQ ID NO: 4022 - protein, 304 aa, Schizosaccharomyces pombe
MEESSAAKIQLLKEFKFEKILKDDTKSKIITLYGKIRNEVALLLLEKTAFDLNTIKLDQLATFLQDTKLVENNDVFHWFLSTNFQDCSTLPSVKSTLIWPASETHVRKYSSQKKRMVCETPEMYLKVTKPFIETQRGPQIQWVENILTHKAEAERIVVEDPDPLNGFIVIPDLKWDRQTMSALNLMAIVHATDIASIRDLKYKHIPLLENIRNKVLTEVPKQFSVDKNQLKMFVHYLPSYYHLHVHILHVDHETGDGSAVGRAILLDDVIDRLRNSPDGLENVNITFNIGEQHFLFQPLTNMNA

SEQ ID NO: 4023 - protein, 188 aa, Schizosaccharomyces pombe
KLLGPLKQSTWVKLIVCSSTPSEDLVELVKSTAPDVEIITYDNLLSLGKEKPQPPHPPKADDICCYMYTSGSTGKPKGVVLLHRNIIAALGGINRILSQHINVKDYVLAYLPLAHIFEFIFEMCCLYWGGVLGYASPRTLTDASVVNCKGDLTEFRPTVLIGVPAVYELIKKGILAKVSSMPAHRQKV

SEQ ID NO: 4024 - protein, 183 aa, Schizosaccharomyces pombe
LKQSTWVKLIVCSSTPSEDLVELVKSTAPDVEIITYDNLLSLGKEKPQPPHPPKADDICCYMYTSGSTGKPKGVVLLHRNIIAALGGINRILSQHINVKDYVLAYLPLAHIFEFIFEMCCLYWGGVLGYASPRTLTDASVVNCKGDLTEFRPTVLIGVPAVYELIKKGILAKVSSMPAHRQKV

SEQ ID NO: 4025 - protein, 66 aa, Schizosaccharomyces pombe
FTLINTVSLVSGWLKMLHQRIDYKILTEKVMHFKDMEVPSATVIISIKMAHLLVTPKAPYSFSVLL

SEQ ID NO: 4026 - protein, 157 aa, Schizosaccharomyces pombe
KDMEVPSATVIISIKMAHLLVTPKAPYSFSVLLQDPESEFCVHTRDVYDELVPNWKETYQMEITNVKRFKLIIYQRNIHTGLETVYGHATLEVDPDKLKQGHGKDVWLDITNKGQILIGLRVLLKRETPNYYCFAQMEYLTVTEVKMLNVLMISLSK

SEQ ID NO: 4027 - protein, 221 aa, Schizosaccharomyces pombe
MLSRAGKVVCIGRNYAAHIRELNNPFPTKPFFFLKPTSAIVEPGHGNLIIPPDVSAHYEVELGLIMKDRLPARRPVSSNSWLDSIGAYFVGIDMTARNIQNEAKKKGLPWSFAKGYDTFLPVGPIIPKHLIPDPHNVILELSLNGKVVQKDSTSLMLNKIPKIFSSITEAMSLNPGDLVLTGTPKGVGPVVPGDILSARLLTAQEQEIIPSKFEIKAEKCD

SEQ ID NO: 4028 - protein, 332 aa, Schizosaccharomyces pombe
MRIAFFSAQPYEKEPFEKVNENYKHEIDYHESILNKKTAVLAEKAPVVCVFVNDKVDADTLKVLAKNGTKLIALRCAGFNNVDLKAAADNGITVVRVPAYSPYAVAEYTIGLLLSLNRKIHRAYVRVREDDFNLNGLLGHDLHGKTIGLLGTGRIGGLVAKCLKLGFGCEVLAHDIKPNKELEKFGIQFVEQQEVLAKADFLCLHCPLTPDTEHLVDEKLLASMKKGVKIINTSRGGLVDTKALVKAIESGQVGGCAMDVYEGERRLFYRDLSNEVIKDTTFQQLANFPNVLVTSHQAFFTAEALSAIAHTTLKNVSDFASQNNDPSVIVKN

SEQ ID NO: 4029 - protein, 1573 aa, Schizosaccharomyces pombe
MSNESNIITVPILGKDTVRVGFGIHQYICTEILENFKSSTYVVITDSNIAPLYLEKIESTFNKSIKDAKAEARLLTYVIPPGESSKCRAMKAEIEDWLLTQSCTRDTILIAMGGGVIGDLVGYVAASFMRGIRFIQMPTTLLAMVDSSIGGKTGIDTPLGKNLVGAFWQPLRVYVDMVFLHTLPPRQVINGLSEIIKTAAMWNENDFQLLENNSAVLLDALNKPSVPGEYKFDSIKPLLQKIILSSIRTKCEVVTLDEHEGGLRNLLNFGHSIGHAYEAILYPQILHGECVAIGMVKEAELARYLGILKPNAVGRLTKCLVSYNLPISVNDPKVKKYASFKHCPVEKLIEYMAVDKKNQGSKKRIVILKAIGETYEKHATVVSDDDIRFILSRDVKVDEFTKSSWDVVVTPPGSKSISNRALVLAAMGNGTCRLTNMLHSDDTQFMMSALESLGAATFSWEDGGETLVVKGNGGKLAVPKEELYLGNAGTAARFLTGIAALVSSKDGAKVVLTGNHRMKVRPIGPLVDALRANGCEINYLEKQGSLPLDLSSKNGLKGGIIELAATVSSQYVSSILMCAPYASQPVTLKLVGGKPISQLYIDMTIAMMASFGVNVTKSTTEENTYNIPCGKYQNPPHYEIESDASSATYPLAIAAITGTKCTVPNIGSASLQGDARFACDVLRPMGCTVEQTATSTTVQGPPKGTLKPLESIDMETMTDAFLTASVVAAVACNVSEGDPVTRITGIANQRVKECNRIAAMVHELAKFGVRTGELEDGIYIFGKNYKELKKPEEGIYTYDDHRIAMSFSVLSLICPSRTLIIDKACVEKTWPYWWDVLHQSFGVKLTGATSVASDPLKGSISKNASIILIGMRGAGKTTIGKIIAKQLNFKFLDLDELLEDYLEMPIAEVIFRMGWDAFRLEEHKVLRKFITEHPEGYVAASGGGVIEMDESRNLLSNFVKEGGIVLHVHRNLEHIKSYLSEDQTRPTYKDQESIDDVYKRRHVWYRECRSHYFISPVLSNQVIDEKIQYSMSRFLDVVTGSSQVLQKFKTKKRSTFLTLNYPRIEDALPTLRDVTVGCDAIEVRVDYLKDPKSSNGISSLDFVAEQISLLRCSTTLPIIFTIRTISQGGLFPNDKEEEAKELMLSAMRYGCDFVDVELGWSSETINILYQHKGYTKLIMSWHDLSGTWSWARPHEWMQKVELASSYADVIKLVGMANNLNDNLELEEFRTRITNSMDIPLILFNMGRFGQLSRILNKFMTPVTHPLLPSKAAPGQLTVKQLNEARVLIGEILPEKFFLFGKPIKHSRSPILHSTAYELLGLPHTYEAFETDTVDEVQKVLNLPDFGGANVTIPYKLSVMKFMDELSDEARFFGAVNTIIPIRIGDKLVLRGDNTDWRGIYDTFANALDGVSLRDTNGLVIGAGGTSRAAIYSLHRLGVSRIYLLNRTLANSYRVQDVFPPDYNIHIIDSDNIPSEELSSVTLSAVVSTIPADIELPEKVASVIKALLANKADGGVFLDMAYKPLHTPLMAVASDLEWKCCNGLEALVRQGLASFHLWTGMTAPFDAVYQKVIE

SEQ ID NO: 4030 - protein, 96 aa, Schizosaccharomyces pombe
WCSYILEVIAGCTGESLMAKLAKAEYQGAYMQVLRSKSTTRVGLEGICIHESKHMLSLITKENRVVRVPKQDSVMKVIVDVPQRKLVFELYTQHLL

SEQ ID NO: 4031 - protein, 97 aa, Schizosaccharomyces pombe
WCSYILEVIAGCTGESLMAKLAKAEYQGAYMQVLRSKSTTRVGLEGICIHESKHMLSLITKENRVVRVPKQDSVMKVIVDVPQRKLVFELYTQHLLL

SEQ ID NO: 4032 - protein, 251 aa, Campylobacter jejuni
MKRIVVKVGSHVISEENTLSFERLKNLVAFLAKLMEKYEVILVTSAAISAGHTKLDIDRKNLINKQVLAAIGQPFLISVYNELLAKFNKLGGQILLTGKDFDSRKATKHAKNAIDMMINLGILPIINENDATAIEEIVFGDNDSLSAYATHFFDADLLVILSDIDGFYDKNPSEFSDAKRLEKITHIKEEWLQATIKTGSEHGTGGIVTKLKAAKFLLEHNKKMFLASGFDLSVAKTFLLEDKQIGGTLFE

SEQ ID NO: 4033 - protein, 371 aa, Campylobacter jejuni
MSEMSLIMLAAGNSTRFNTKVKKQFLRLGNDPLWLYATKNLSSFYPFKKIVVTSSNITYMKKFTKNYEFIEGGDTRAESLKKALELIDSEFVMVSDVARVLVSKNLFDRLIENLDKADCITPALKVADTTLFDNEALQREKIKLIQTPQISKTKLLKKALDQNLEFTDDSTAIAAMGGKIWFVEGEENARKLTFKEDLKKLDLPTPSFEIFTGNGFDVHEFGENRPLLLAGVQIHPTMGLKAHSDGDVLAHSLTDAILGAAGLGDIGELYPDTDMKFKNANSMELLKQAYDKVREIGFELINIDICVMAQSPKLKDFKQAMQSNIAHTLDLDEFRINVKATTTEKLGFIGRKEGMAVLSSVNLKYFDWTRL

SEQ ID NO: 4034 - protein, 400 aa, Campylobacter jejuni
MSDIISIKDIDLAKKKVFIRCDFNVPQDDFLNITDDRRIRSAIPTIRYCLDNGCSVILASHLGRPKEISSKYSLEPVAKRLARLLDKEIVMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFVAVVGGSKVSGKLQALTNLLPKVDKLIIGGGMAFTFLKALGYDIGNSLLEEELLEEANKILTKGKNLGVKIYLPVDVVAAPACSQDVPMKFVPAQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 4035 - protein, 333 aa, Trachemys scripta
MATLQEKLITPIAAESTTPNNKITVVGVGQVGMACAISILGKGLCDELALVDVWEDKLKGEMMDLQHGSLVLQTHKIVADKDYAVTANSKIVVVTAGVRQQEGESRLNLVQRNVNVFKFIIPQIMKYSPNCTILVVSNPVDILTYVTWKLSGLPKHRVIGSGCNLDSARFRHLMAEKLGIHPTSCHGWILGEHGDSSVAVWSGVNVAGVSLQELNPAMGTDRDSENWKEVHKLVVDSAYEVIKLKGYTNWAIGFSVADLIESMLKNLCRVHPVSTMVKGMYGIENEVFLSLPCVLSASGLTSVINQKLKDEEVAQLKKSADTLWGIQKDLKDL

SEQ ID NO: 4036 - protein, 293 aa, Gallus gallus
MDNPSIITQVTNPKEEEILSCTQDKVSQCNISLKKQRSRSIFSTLFCCFRDYNVEPPSTNSTSALPPLVEENGGLQKPPAKYLLPELTASDYGKKCVVIDLDETLVHSSFKPISNADFIVPVEIDGTIHQVYVLKRPHVDEFLQRMGELFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSKEEEVYSMLHKLCNSSFKCKLWGGHSCQKCYSRSSCYIGHKGQS

SEQ ID NO: 4037 - protein, 401 aa, Xenopus laevis
MQVSFACTEQTLRSRTSEDRLCPSRPSGGQNGVSMAQTKQRTPPMGAKNHNQVLPLLSHILRESTVKSTGMKYRNLGKSGLRVSCLGLGTWVTFGSQISDEVAENLMTVAYEHGVNLFDTAEVYAAGRAERTLGKILKKKEWRRSSYVVTTKIYWGGQAETERGLSRKHIIEGLRGSLERLQLDYVDIVFANRMDPNSPMEEIVRAMTFVINQGMAMYWGTSRWSAMEIMEAYSVARQFNLIPPVCEQAEYHLFQREKVETQLPELYHKIGVGSMTWSPLACGLITGKYTDTVPEKSRASFKGYHWLKEKAISQEGKKQHSKVKELHPIADRLNCTVTQLAIAWCLRSEGVSSVLLGVSNIEQLLENLGAIQVLPHLTPQLVTEIDQILGNKPNLKKDSRA

SEQ ID NO: 4038 - protein, 1087 aa, Gallus gallus
MGTPPRTFLILGCFLTGPLLTLCQLPLPTIVPNRNEMVVQLNSNFTLKCSGDSEVSWQYPVTEGSHRIDIRHEENNSGLFVTVLEVGNASAAHTGMYVCYYNHTQVEDGEVEGKDIYIYVPDPDMPFVPSLPEDQFILVEEGDPTVIPCRTSDPSAEVTLVNSLDKPVYAFYDSKQGFVGNFLAGPYTCKTMVKGVEFKSDEFLIYILRATSQLPVEIEALKTVYKTGETIVVTCVVFDNEVVNLQWNYPGKVKEKGLIKLDDIKVPSQKLVYMLTIPDVLVKDTGDYECTARHATKEVKENKKVVITVHDKGFIHLEPQFSPLEAVNLHEVKNFVVDVQAYPAPKMYWLKDNVTLIENLTEIVTSSNRVQETRFQSVLKLIRAKEEDSGTILWLLKNEDEIKRYTFSLLIQVPALILDLMDDHQGSAGRQTVRCLAEGTPLPDVEWLVCKDIKKCSNDTSWTLLTNNISDIHMEAHLDERNMVESQVTFQKVEETLAVRCVARNDLGAVTRELKLVAPTLRSELTVAAAVLVLLVIVIISLIVLVIIWKQKPRYEIRWRVIESISPDGHEYIYVDPMQLPYDSRWEFPRDGLVLGRILGSGAFGKVVEGTAYGLSRSQPVMKVAVKMLKPTARSSEKQALMSELKIMTHLGPHLNIVNLLGACTKSGPIYIITEYCFYGDLVNYLHKNRDNFLSRHPEKPKKDLDIFGMNPADESTRSYVILSFENTGEYMDMKQADTTQYVPMLERKEGSKYSDIQRSVYDRPASYKKKSLSESEVKNLLSDDGSEGLSLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGILYPGMMVDSTFYNKIKSGYRMAKPDHATNEVYEIMVKCWNNEPEKRPSFYHLSEIVESLLPGEYKKSYEKIHLDFLKSDHPAVTRMRGDCDNAYIGVTYKNEDKIKDRESGFDEQRLSADSGYITPLPDIDPVSEDELGKRNRHSSQTSEESAIETGSSSSTFIKREDETIEDIDMMDDIGIDSSDLVEDSFL

SEQ ID NO: 4039 - protein, 319 aa, Danio rerio
MPREDRATWKSNYFLKIIQLLDDFPKCFIVGADNVGSKQMQTIRLSLRGKAVVLMGKNTMMRKAIRGHLENNPALERLLPHIRGNVGFVFTKEDLTEVRDLLLANKVPAAARAGAIAPCEVTVPAQNTGLGPEKTSFFQALGITTKISRGTIEILSDVQLIKPGDKVGASEATLLNMLNMLNISPFSYGLIIQQVYDNGSVYSPEVLDITEDALHKRFLKGVRNIASVCLQIGYPTLASIPHTIINGYKRVLAVTVETDYTFPLAEKVKAYLADPTAFAVAAPVAAATEQKSAAPAAKEEAPKEDSEESDEDMGFGLFD

SEQ ID NO: 4040 - protein, 144 aa, Seriola quinqueradiata
MSLSAKDKTTVKKFWDKVEGKSAEIGGEALGRMLVAYPQTKAYFSHWGSDLNPQHPMVKKHGAIIMGGIGKAVKNIDDLVRGLSALSELHAFKLRVDPANFKILAHNVILVAAMYFPADFTPEVHVSVDKFLQRVALALAERYR

SEQ ID NO: 4041 - protein, 143 aa, Seriola quinqueradiata
MSLSGKDKSVVKAFWDKMSPKSAEIGAEALGRMLTVYPQTKTYFSHWADVGPDSAQVKKHGATIMAAVGDAVGKIDDLVGGLSALSELHAFKLRVDPANFRILAHNIILVTAMYFPTDFTPEIHVSVDKFLQNLALALAERYR

SEQ ID NO: 4042 - protein, 144 aa, Oryzias latipes
MTSLSAKDKDVVKAFWAKISSKATDIGADALGRMLVVYPQTKTYFAHWKDLSPGSAPVKKHGQTVMGGVAEAVGKIDNLTAGLLNLSELHAFTLRVDPANFKILSHNILVVLAIMFPNDFTPEVHVAMDKFLAALALALAEKYR

SEQ ID NO: 4043 - protein, 333 aa, Columba livia
MATVKEKLMTPLTAGIKVPNNKISIVGVGQVGMASAISILGKGLCDELALVDVMEDRLKGEMMDLQHGSLFPHTHKIVADKDYAVTANSKIVVVTAGVRQQEGESRLNLVQRNVNVFKFIIPQIVKYSPNCTILVVSNPVDILTYVTWKLSGLPKHRVIGSGCNLDTARFRYLMSERLGIHPDSCHGWILGEHGDSSVAVWSGVNVAGVPLKELNPAMGTDKDSENWKEVHKQVVDSAYEVIKLKGYTNWAIGLSVANLCETILKDLYRVHSVSTLFKGMYGIENDVFLSLPSVLSAAGLTSVINPKLKDDEVAQLKKSAETLWNIQKDLQDL

SEQ ID NO: 4044 - protein, 40 aa, Columba livia
VIKLKGYTNWAIGLSVANLCETILKDLYRVHSVSTLFKGM

SEQ ID NO: 4045 - protein, 122 aa, Columba livia
ASAISILGKGLCDELALVDVMEDRLKGEMMDLQHGSLFPHTHKIVADKDYAVTANSKIVVVTAGVRQQEGESRLNLVQRNVNVFKFIIPQIVKYSPNCTILVVSNPVDILTYVTWKLSGLPK

SEQ ID NO: 4046 - protein, 52 aa, Gallus gallus
SVIVNVLVKPSKPFCKIEGTPEKGHLIYLLCKCDQGLPHPTYRWYKVDENTL

SEQ ID NO: 4047 - protein, 711 aa, Mus musculus
MNLKLNVLTIILLPVHLLITIYSALIFIPWYFLTNAKKKNAMAKRIKAKPTSDKPGSPYRSVTHFDSLAVIDIPGADTLDKLFDHAVAKFGKKDSLGTREILSEENEMQPNGKVFKKLILGNYKWINYLEVNCRVNNFGSGLTALGLKPKNTIAIFCETRAEWMIAAQTCFKYNFPLVTLYATLGREAVVHGLNESEASYLITSVELLESKLKAALVDINCVKHIIYVDNKTINRAEYPEGLEIHSMQSVEELGAKPENLSVPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYVQKTLFKIGYDYKLEQIKKGYDAPLCNLILFKKVKALLGGNVRMMLSGGAPLSPQTHRFMNVCFCCPIGQGYGLTESCGAGTVTEVTDYTTGRVGAPLICCEIKLKDWQEGGYTVHDKPNPRGEIVIGGQNISMGYFKNEEKTAEDYCVDENGQRWFCTGDIGEFHPDGCLQIIDRKKDLVKLQAGEYVSLGKVEAALKNCPLIDNICAFAKSDQSYVISFVVPNQKKLTLLAQQKGVEGSWVDICNNPAMEAEILKEIREAANAMKLERFEIPIKVRLSPEPWTPETGLVTDAFKLKRKELKNHYLKDIERMYGGK

SEQ ID NO: 4048 - protein, 343 aa, Mus musculus
MDPKGSLSWRILLFLSLAFELSYGTGGGVMDCPVILQKLGQDTWLPLTNEHQINKSVNKSVRILVTMATSPGSKSNKKIVSFDLSKGSYPDHLEDGYHFQSKNLSLKILGNRRESEGWYLVSVEENVSVQQFCKQLKLYEQVSPPEIKVLNKTQENENGTCSLLLACTVKKGDHVTYSWSDEAGTHLLSRANRSHLLHITLSNQHQDSIYNCTASNPVSSISRTFNLSSQACKQESSSESSPWMQYTLVPLGVVIIFILVFTAIIMMKRQGKSNHCQPPVEEKSLTIYAQVQKSGPQEKKLHDALTDQDPCTTIYVAATEPAPESVQEPNPTTVYASVTLPES

SEQ ID NO: 4049 - protein, 329 aa, Mus musculus
MDPKGSLSWRILLFLSLAFELSYGTGGGVMDCPVILQKLGQDTWLPLTNEHQINKSVNKSVRILVTMATSPGSKSNKKIVSFDLSKGSYPDHLEDGYHFQSKNLSLKILGNRRESEGWYLVSVEENVSVQQFCKQLKLYEQVSPPEIKVLNKTQENENGTCSLLLACTVKKGDHVTYSWSDEAGTHLLSRANRSHLLHITLSNQHQDSIYNCTASNPVSSISRTFNLSSQACKQESSSESSPWMQYTLVPLGVVIIFILVFTAIIMMKRQGKSNHCQPPVEEKSLTIYAQVQKSGVRSMPHLAGVSVIFRTGFLIAALHTTMVLQGLLE

SEQ ID NO: 4050 - protein, 145 aa, Mus musculus
GLFLLVSCMFLWVYVTATRYDRKSNEEIYDNLLSSSRHIHRVAKKMYKILDSKLTEGVCFRNKNTKMCQTISTHSVKKNEDLLKVIINVSNFWTYPLKMLIPAVLTHLDSDDGMMTRAVELNYGNKVVLEGAKALLSRIQPGIEE

SEQ ID NO: 4051 - protein, 24 aa, Mus musculus
KVIINVSNFWTYPLKMLIPAVLTH

SEQ ID NO: 4052 - protein, 85 aa, Rattus norvegicus; identical to SEQ ID NO: 2735

SEQ ID NO: 4053 - protein, 73 aa, Rattus norvegicus; identical to SEQ ID NO: 252

SEQ ID NO: 4054 - protein, 84 aa, Rattus norvegicus
DTLWLIPITFLTIGYGDVVPGTLWGKIVCLCTGVMGVCCTALLVAVVARKLEFNKAEKHVHNFMMDIHYAKEMKESAARLLQEA

SEQ ID NO: 4055 - protein, 30 aa, Rattus norvegicus; identical to SEQ ID NO: 523

SEQ ID NO: 4056 - protein, 111 aa, Mus musculus
LSTHVKPGQKLNLFCGTYPFSAPEVLLSRPYGGPKIDVWTLGVVLYFMVIGKIPFDAASIEKLRKQIVAGKYSAPCRLSVKLQHLINLLMTDNPELRPTVAEVMVHPWITK

SEQ ID NO: 4057 - protein, 84 aa, Mus musculus
TLGVVLYFMVIGKIPFDAASIEKLRKQIVAGKYSAPCRLSVKLQHLINLLMTDNPELRPTVAEVMVHPWITKGSGVFPDPCEEQ

SEQ ID NO: 4058 - protein, 198 aa, Mus musculus
LQEHEARALFKQLLSAMNYCHNQGIVHRDLKPDNIMVEKDGKVKIIDFGLGTKVKPGQKLNLFCGTYPFSAPEVLLSTPYDGPKIDVWTLGVVLYFMVTGKIPFDACSIKKLVKRILAGKYSIPSRLSAELQDLLSLLMTANPKLRPTVAEVMVHPWVTEGSGVFPDPCEEQTPLKPDPAIVKAMGHIGFQAQDIEDS

SEQ ID NO: 4059 - protein, 177 aa, Mus musculus
TVKLAQHRLTGTHVAVKTIRKREYWCNRVISEVELLMMADHPNIISLLQVIETKKKVYLIMELCKGKSLYQHIRKAGYLQEHEARALFKQLLSAMNYCHNQGIVHRDLKPDNIMVEKDGKVKIIDFGLGTKVKPGQKLNLFCGTYPFSAPEVLLSTPYDGPKIDVWTLGVVLYFMVT

SEQ ID NO: 4060 - protein, 57 aa, Mus musculus
KIDVWTLGVVLYFMVTGKIPFDAASIEKLRKQIVAGKYSVPCRLSVKLHHLITLLMT

SEQ ID NO: 4061 - protein, 137 aa, Mus musculus
IDVWTLGVVLYFMVTGKIPFDAASIEKLRKQIVAGKYSVPCRLSVKLHHLITLLMTDNPELRPTVAEVMMHPWVTKGSGVFPDPCEEQIPLKPDPAIVKAMGHIGFQAQDIEDSLRQRKFNETMASYCLLKKQLLKE

SEQ ID NO: 4062 - protein, 182 aa, Mus musculus
MLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKS

SEQ ID NO: 4063 - protein, 186 aa, Mus musculus; identical to SEQ ID NO: 2246

SEQ ID NO: 4064 - protein, 417 aa, Mus musculus
MPLYEGLGSGGEKTAVVIDLGEAFTKCGFAGETGPRCIIPSVIKRAGMSKPIKVVQYNINTEELYSYLKEFIHILYFRHLLVNPRDRRVVVIESVLCPSHFRETLTRVLFKYFEVPSVLLAPSHLMALLTLGINSAMVLDCGYRESLVLPIYEGIPILNCWGALPLGGKALHKELETQLLEQCTVDTGAAKGQSLPSVMGSVPEGVLEDIKVRTCFVSDLKRGLQIQAAKFNIDGNNERPTPPPNVDYPLDGEKILHVLGSIRDSVVEILFEQDNEEKSVATLILDSLLQCPIDTRKQLAENLVIIGGTSMLPGFLHRLLAEIRYLVEKPKYKKTLGTKNFRIHTPPAKANCVAWLGGAVFGALQDILGSRSISKEYYNQTGRIPDWCSLNNPPLEMMFDVGKAQPPLMKRAFSTEK

SEQ ID NO: 4065 - protein, 227 aa, Mus musculus
MDPFGFVLLDKEGMKYEKTQTKKPGKAKVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSVTIETVDVGWCKEITDQGATLIAQSSKSLRYLGLMRCDKVNELTVEQLVQQYPHITFSTVLQDCKRTLERAYQMGWTPNMSAATS

SEQ ID NO: 4066 - protein, 178 aa, Mus musculus
KKPGKAKVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSVTIETVDVGWCKEITDQGATLIAQSSKSLRYLGLMRCDKVNELTVEQLVQQYPHITF

SEQ ID NO: 4067 - protein, 178 aa, Mus musculus
QEQEKSQEPCFPCGKNLASKYLVWECSPPWLCIKKVLQTIMTDPFTELAITICIIVNTVFLAMEHHNMDNSLKDILKIGNWVFTGIFIAEMCLKIIALDPYHYFRHGWNIFDSIVALVSLADVLFHKLSKNLSFLASLRVLRVFKLAKSWPTLNTLIKIIGHSVGALGNLTVVLTIVV

SEQ ID NO: 4068 - protein, 65 aa, Mus musculus
KLAKSWPTLNTLIKIIGHSVGALGNLTVVLTIVVFIFSVVGMRLFGAKFNKTCSTSPESLRRWHM

SEQ ID NO: 4069 - protein, 162 aa, Rattus norvegicus
MAPIKVGDTIPSVEVFEGEPGKKVNLAELFKDKKGVLFGVPGAFTPGCSKTHLPGFVEQAGALKAKGAQVVACLSVNDAFVTAEWGRAHQAEGKVQLLADPTGAFGKETDLLLDDSLVSLFGNRRLKRFSMVIDKGVVKALNVEPDGTGLTCSLAPNILSQL

SEQ ID NO: 4070 - protein, 523 aa, Mus musculus
MSFRKEDGVSSLCQKALHIITELCFAGQVEWDKCSGIFPADRSGQGGGGTDISVSLLAVVVSFCGLALLVVSLFVFWKLCWPCWKSKLVAPNLSVLPQSISSAPTEVFETEEKKEVEENEKPAPKAIEPAIKISHTSPDIPAEVQTALKEHLIKHARVQRQTTEPTSSSRHNSFRRHLPRQMNVSSVDFSVGTEPILQRGETRTSIGRIKPELYKQKSVDSEGNRKDDVKTCGKLNFALQYDYENELLVVKIIKALDLPAKDFTGTSDPYVKIYLLPDRKKKFQTRVHRKTLNPLFDELFQFPVVYDQLSNRKLHFSIYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLCIAVMDYDRVGHNEVIGVCRTGLDAEGLGRDHWNEMLAYHRKPITHWHPLLELPGRATSFDSQGSCSSPRPPSTP

SEQ ID NO: 4071 - protein, 199 aa, Mus musculus
NLIIPCLFISFLTVLVFYLPSDCGEKVTLCISVLLSLTVFLLVITETIPSTSLVIPLVGEYLLFTMIFVTLSIVVTVFVLNIHYRTPATHTMPKWVKTIFLQAFPSILMMRKPLDKTKEAGGVKDPKSHTKRPAKVKFTHRGESKLLKECHHCQKSSDIAPGKRRSSQQPARWVAENSEHSSDVEDVIESVQFIAENMK

SEQ ID NO: 4072 - protein, 112 aa, Mus musculus
LCISVLLSLTVFLLVITETIPSTSLVIPLVGEYLLFTMIFVTLSIVVTVFVLNIHYRTPATHTMPKWVKTIFLQAFPSILMMRKPLDKTKEAGGVKDPKSHTKRPAKVKFTH

SEQ ID NO: 4073 - protein, 530 aa, Cavia porcellus
MAPGKLASAVLLLLLCCAGSGFCGKVLVWPCEMSHWLNLKTLLEELVKRGHEVTVLTLSNNLFIDYNRHPAFNFEVIPVPTDKNMSENILNEFIELAVNVMPTMPLWQSGKLLQQFFVQITEDLGLNCRNTVYNQSLMKKLRDSKYDVLVTDPVIPCGELVAEMLGVPFVNMLKFSMGHTIEKYCGQLPAPPSYVPVPLGGLTTRMTFMERVKNMVFSVLFDFWIQQYDYKFWDQFYSEALGRPTTLCEIMGKAEIWLIRTYWDFEFPRPYLPNFEFVGGLHCKPAKPLPKEMEEFVQSSGEDGVVVFSLGSMVKNLTEEKANLIASALAQIPQKVLWRYKGKKPATLGPNTRLFDWIPQNDLLGHPKTKAFITHGGSNGIYEAIYHGVPMVGMPIFSDQPDNLAGMKAKGAAVEVNMNTMTSADLLGALRTVINDPTYKENAMKLSRIHHDQPVKPLDRAAFWVEFVMHHKGAKHLRVAAHDLSWFQYHSLDVIGFLLACVASAILLVTKCCLFSFQNFIKIGKRIKKE

SEQ ID NO: 4074 - protein, 163 aa, Rattus norvegicus
LKQFKTKRYFPTKVRSTISDFAVFLTIVIMVAIDYLVGIPSPKLHVPEKFEPTDPSRGWIISPLGDNPWWTLLIAAVPALLCTILIFMDQQITAVIINRKEHKLKKGAGYHLDLLMVAVMLGVCSIMGLPWFVAATVLSISHVNSLKVESECSAPGEQPKFLG

SEQ ID NO: 4075 - protein, 123 aa, Rattus norvegicus
LKQFKTKRYFPTKVRSTISDFAVFLTIVIMVAIDYLVGIPSPKLHVPEKFEPTDPSRGWIISPLGDNPWWTLLIAAVPALLCTILIFMDQQITAVIINRKEHKLKKGAGYHLDLLMVAVMLGV

SEQ ID NO: 4076 - protein, 163 aa, Rattus norvegicus; identical to SEQ ID NO: 4074

SEQ ID NO: 4077 - protein, 123 aa, Rattus norvegicus; identical to SEQ ID NO: 4075

SEQ ID NO: 4078 - protein, 123 aa, Rattus norvegicus; identical to SEQ ID NO: 4075

SEQ ID NO: 4079 - protein, 163 aa, Rattus norvegicus; identical to SEQ ID NO: 4074

SEQ ID NO: 4080 - protein, 1131 aa, Rattus norvegicus
MEADGAGEQMRPLLTRGPDEEAVVDLGKTSSTVNTKFEKEELESHRAVYVGVHVPFSKESRRRHRHRGHKHHHRRRKDKDSDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDDSIRENVREALLKRHHHQNEKRFTSRIPLVRSFADIGKKHSDPHLLERNGILASPQSAPGNLDSSKSGEVKGNGSGGSRENSTVDFSKVDMNFMRKIPTGAEASNVLVGEVDFLERPIIAFVRLAPAVLLSGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPAFPNGSAPVSADPPKEADHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILFKFCRDYHLSYLSLRTSIGLWTSFLCIVLVATDASSLVCYITRFTEEAFAALICIIFIYEALEKLFHLGEIYAFNMHNNLDALTSYTCVCAEPSNPSNETVELWERKNVTAASISWANLTVSECKTFHGMFVGSACGPHGPYVPDVLFWCVVLFFTTFFLSSFLKQFKTKRYFPTKVRSTISDFAVFLTIVIMVAIDYLVGIPSPKLHVPEKFEPTDPSRGWIISPLGDNPWWTLLIAAVPALLCTILIFMDQQITAVIINRKEHKLKKGAGYHLDLLMVAVMLGVCSIMGLPWFVAATVLSISHVNSLKVESECSAPGEQPKFLGIREQRVTGLMIFILMGLSVFMTSVLKFIPMPVLYGVFLYMGVSSLKGIQFFDRIKLFGMPAKHQPDLIYLRYVPLWKVHVFTVVQLTCLVLLWVIKASAAAVVFPMMVLALVFVRKLMDLCFTKRELSWLDDLMPESKKKKEDDKKKKEKEEAERMLQGDGDTVHLPFERGSLLQIPVKTLKYSIDPSVVNISDEMAKTAQWKALSMNTENAKVTRPNMSPEKPVSVTINFEDEPSKKYMDAETSL

SEQ ID NO: 4081 - protein, 123 aa, Rattus norvegicus; identical to SEQ ID NO: 4075

SEQ ID NO: 4082 - protein, 163 aa, Rattus norvegicus; identical to SEQ ID NO: 4074

SEQ ID NO: 4083 - protein, 1120 aa, Rattus norvegicus
MEADGAGEQMRPLLTRGPDEEAVVDLGKTSSTVNTKFEKEELESHRAVYVGVHVPFSKESRRRHRHRGHKHHHRRRKDKDSDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDDSIRENVREALLKRHHHQNEKRFTSRIPLVRSFADIGKGILASPQSAPGNLDSSKSGEVKGNGSGGSRENSTVDFSKVDMNFMRKIPTGAEASNVLVGEVDFLERPIIAFVRLAPAVLLSGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPAFPNGSAPVSADPPKEADHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILFKFCRDYHLSYLSLRTSIGLWTSFLCIVLVATDASSLVCYITRFTEEAFAALICIIFIYEALEKLFHLGEIYAFNMHNNLDALTSYTCVCAEPSNPSNETVELWERKNVTAASISWANLTVSECKTFHGMFVGSACGPHGPYVPDVLFWCVVLFFTTFFLSSFLKQFKTKRYFPTKVRSTISDFAVFLTIVIMVAIDYLVGIPSPKLHVPEKFEPTDPSRGWIISPLGDNPWWTLLIAAVPALLCTILIFMDQQITAVIINRKEHKLKKGAGYHLDLLMVAVMLGVCSIMGLPWFVAATVLSISHVNSLKVESECSAPGEQPKFLGIREQRVTGLMIFILMGLSVFMTSVLKFIPMPVLYGVFLYMGVSSLKGIQFFDRIKLFGMPAKHQPDLIYLRYVPLWKVHVFTVVQLTCLVLLWVIKASAAAVVFPMMVLALVFVRKLMDLCFTKRELSWLDDLMPESKKKKEDDKKKKEKEEAERMLQGDGDTVHLPFERGSLLQIPVKTLKYSIDPSVVNISDEMAKTAQWKALSMNTENAKVTRPNMSPEKPVSVTINFEDEPSKKYMDAETSL

SEQ ID NO: 4084 - protein, 123 aa, Rattus norvegicus; identical to SEQ ID NO: 4075

SEQ ID NO: 4085 - protein, 163 aa, Rattus norvegicus; identical to SEQ ID NO: 4074

SEQ ID NO: 4086 - protein, 1095 aa, Rattus norvegicus
MEADGAGEQMRPLLTRGPDEEAVVDLGKTSSTVNTKFEKEELESHRAVYVGVHVPFSKESRRRHRHRGHKHHHRRRKDKDSDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDDSIRENVREALLKRHHHQNEKRFTSRIPLVRSFADIGKKHSDPHLLERNGILASPQSAPGNLDSSKSGEVKGNGSGGSRENSTVDFSKVDMNFMRKIPTGAEASNVLVGEVDFLERPIIAFVRLAPAVLLSGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPAFPNGSAPVSADPPKEADHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILFKFCRDYHLSYLSLRTSIGLWTSFLCIVLVATDASSLVCYITRFTEEAFAALICIIFIYEALEKLFHLGEIYAFNMHNNLDALTSYTCVCAEPSNPSNETVELWERKNVTAASISWANLTVSECKTFHGMFVGSACGPHGPYVPDVLFWCVVLFFTTFFLSSFLKQFKTKRYFPTKVRSTISDFAVFLTIVIMVAIDYLVGIPSPKLHVPEKFEPTDPSRGWIISPLGDNPWWTLLIAAVPALLCTILIFMDQQITAVIINRKEHKLKKGAGYHLDLLMVAVMLGVCSIMGLPWFVAATVLSISHVNSLKVESECSAPGEQPKFLGIREQRVTGLMIFILMGLSVFMTSVLKFIPMPVLYGVFLYMGVSSLKGIQFFDRIKLFGMPAKHQPDLIYLRYVPLWKVHVFTVVQLTCLVLLWVIKASAAAVVFPMMVLALVFVRKLMDLCFTKRELSWLDDLMPESKKKKEDDKKKKEKEEAERMLQGDGDTVHLPFERGSLLQIPVKTLKYSPEKPVSVTINFEDEPSKKYMDAETSL

SEQ ID NO: 4087 - protein, 123 aa, Rattus norvegicus; identical to SEQ ID NO: 4075

SEQ ID NO: 4088 - protein, 163 aa, Rattus norvegicus; identical to SEQ ID NO: 4074

SEQ ID NO: 4089 - protein, 1113 aa, Rattus norvegicus
MLEADLVSKMLRAVLQSHKNGIVLPRLQGEYRSLTGDWIPFKQLGYPTLEAYLRSVPAVVRIEASRSGEIVCYAVACTETARIAQLVARQRTSKRKTGRQINCQMRVKKTMPFFLEGKPKATLRQPGFASDYSISKKPNPTLLREKGSTLGAKADVDMPPYPDAPVQRHVSMSANSSVTVLRSHPEASKLQFMGYSPKPHCLLLFSPKSSLPAPFQTHISRACPKEVNDNLNQTVEKPNVTPPASYTNKMDEVQNRIKEILDKHNNGIWISKLPHFYKEFYKEDLNQGVLQQFEHWPHICTVEKPCGGGQDLLLYPAKREQPLRSDQDPEKERPPPPPAPRQEVPSKGSPAVMPDVKEKVAELLGKYSSGLWASALPKAFEDMYKVKFPEDALKNLASLSDVCTINYISGNTQKAILYAKLPLPTDKILKDEAQAQGDFDIKSMIEQEYLQIEKNMAESADDFVEDITVPPLVIPTEASPSVLVVELSNTNDVVIRYVGKDYSAAQELMEDEMKEYYSRNPRVTPIQTVHVGQLLAVNAEEDAWLRAQIISTDENKIKVCYVDYGFCENIEKSKAYRLNPRFCSLSFQATKCKLAGLEILNDDPNLVKVVESLTCGKIFAVEILDKSDIPLVVLYDTSGEDDININATCLKAICDRSLEVHLQVDAMYTNVKVTNICSDGTLYCQVPCKGLNKLNDLLHKTEDYFHCKHMTSEYFISLPFCGKICLFHCKGKWLRVEITNVHSSRALDVQFLDSGNSTSVKVSELREIPPRFLQEMLAIPPQAIKCCLADLPQSIGMWTPDAVLWLRDSVLNCSDCSIKVTKVDEARGVAYVYLFTPKNFPDPHRSINRQITNADLWKHQKDVFLSAVSAAASSPGNRNASTPAPGSPAESLRKSHPEVLRKSVLDHTSSFSLEELPPPVHLSKSGEHMDVYVPVACHPGHFVIQPWQEIHKLEVLMEEMILYYSVSEERHIAVERDQVYAAKVENKWYRVLLKGILTNGLVSVYELDYGKHELVNIRKVQPLVDVFRKLPFQAVTAQLAGVKCSQWSEEASMVFRNHVEKKPLVALVQTVIEHANPWDRKVVVYLVDTSLPDTDTWIHDFMSQYLVELSKAN

SEQ ID NO: 4090 - protein, 1086 aa, Rattus norvegicus
MLEADLVSKMLRAVLQSHKNGIVLPRLQGEYRSLTGDWIPFKQLGYPTLEAYLRSVPAVVRIEASRSGEIVCYAVACTETARIAQLVARQRTSKRKTGRQINCQMRVKKTMPFFLEGKPKATLRQPGFASDYSISKKPNPTLLREKGSTLGAKADVDMPPYPDAPVQRHVSMSANSRFSPKSSLPAPFQTHISRACPKEVNDNLNQTVEKPNVTPPASYTNKMDEVQNRIKEILDKHNNGIWISKLPHFYKEFYKEDLNQGVLQQFEHWPHICTVEKPCGGGQDLLLYPAKREQPLRSDQDPEKERPPPPPAPRQEVPSKGSPAVMPDVKEKVAELLGKYSSGLWASALPKAFEDMYKVKFPEDALKNLASLSDVCTINYISGNTQKAILYAKLPLPTDKILKDEAQAQGDFDIKSMIEQEYLQIEKNMAESADDFVEDITVPPLVIPTEASPSVLVVELSNTNDVVIRYVGKDYSAAQELMEDEMKEYYSRNPRVTPIQTVHVGQLLAVNAEEDAWLRAQIISTDENKIKVCYVDYGFCENIEKSKAYRLNPRFCSLSFQATKCKLAGLEILNDDPNLVKVVESLTCGKIFAVEILDKSDIPLVVLYDTSGEDDININATCLKAICDRSLEVHLQVDAMYTNVKVTNICSDGTLYCQVPCKGLNKLNDLLHKTEDYFHCKHMTSEYFISLPFCGKICLFHCKGKWLRVEITNVHSSRALDVQFLDSGNSTSVKVSELREIPPRFLQEMLAIPPQAIKCCLADLPQSIGMWTPDAVLWLRDSVLNCSDCSIKVTKVDEARGVAYVYLFTPKNFPDPHRSINRQITNADLWKHQKDVFLSAVSAAASSPGNRNASTPAPGSPAESLRKSHPEVLRKSVLDHTSSFSLEELPPPVHLSKSGEHMDVYVPVACHPGHFVIQPWQEIHKLEVLMEEMILYYSVSEERHIAVERDQVYAAKVENKWYRVLLKGILTNGLVSVYELDYGKHELVNIRKVQPLVDVFRKLPFQAVTAQLAGVKCSQWSEEASMVFRNHVEKKPLVALVQTVIEHANPWDRKVVVYLVDTSLPDTDTWIHDFMSQYLVELSKAN

SEQ ID NO: 4091 - protein, 58 aa, Mus musculus
NVAVGFVGWMSYTSLLIIKSHSNIPKGTRKEGKKPHCLLLYSFIATGVLVACFLMIQA

SEQ ID NO: 4092 - protein, 53 aa, Mus musculus
VAVGFVGWMSYTSLLIIKSHSNIPKGTRKEGKKPHCLLLYSFIATGVLVACFL

SEQ ID NO: 4093 - protein, 58 aa, Mus musculus; identical to SEQ ID NO: 4091

SEQ ID NO: 4094 - protein, 53 aa, Mus musculus; identical to SEQ ID NO: 4092

SEQ ID NO: 4095 - protein, 58 aa, Mus musculus; identical to SEQ ID NO: 4091

SEQ ID NO: 4096 - protein, 53 aa, Mus musculus; identical to SEQ ID NO: 4092

SEQ ID NO: 4097 - protein, 84 aa, Mus musculus
CAFEAVQITTQLSSKGLFLVVLIISDIMALHFFFLVKDSGSWLDIGTSISHYVIVMSMTIFLVFLNGLAQLLTTKKLQLCGKPK

SEQ ID NO: 4098 - protein, 65 aa, Mus musculus
VVLIISDIMALHFFFLVKDSGSWLDIGTSISHYVIVMSMTIFLVFLNGLAQLLTTKKLQLCGKPK

SEQ ID NO: 4099 - protein, 181 aa, Methylomonas aminofaciens
MNKYQELVVSKLTNVINNTAEGYDDKILSLVDAAGRTFIGGAGRSLLVSRFFAMRLVHAGYQVSMVGEVVTPSIQAGDLFIVISGSGSTETLMPLVKKAKSQGAKIIVISMKAQSPMAELADLVVPVGGNDANAFDKTHGMPMGTIFELSTLWFLEATIAKLVDQKGLTEEGMRAIHANLE

SEQ ID NO: 4100 - protein, 556 aa, Arabidopsis thaliana
MTTQDVIVNDQNDQKQCSNDVIFRSRLPDIYIPNHLPLHDYIFENISEFAAKPCLINGPTGEVYTYADVHVTSRKLAAGLHNLGVKQHDVVMILLPNSPEVVLTFLAASFIGAITTSANPFFTPAEISKQAKASAAKLIVTQSRYVDKIKNLQNDGVLIVTTDSDAIPENCLRFSELTQSEEPRVDSIPEKISPEDVVALPFSSGTTGLPKGVMLTHKGLVTSVAQQVDGENPNLYFNRDDVILCVLPMFHIYALNSIMLCSLRVGATILIMPKFEITLLLEQIQRCKVTVAMVVPPIVLAIAKSPETEKYDLSSVRMVKSGAAPLGKELEDAISAKFPNAKLGQGYGMTEAGPVLAMSLGFAKEPFPVKSGACGTVVRNAEMKILDPDTGDSLPRNKPGEICIRGNQIMKGYLNDPLATASTIDKDGWLHTGDVGFIDDDDELFIVDRLKELIKYKGFQVAPAELESLLIGHPEINDVAVVAMKEEDAGEVPVAFVVRSKDSNISEDEIKQFVSKQVVFYKRINKVFFTDSIPKAPSGKILRKDLRARLANGLMN

SEQ ID NO: 4101 - protein, 561 aa, Arabidopsis thaliana
MITAALHEPQIHKPTDTSVVSDDVLPHSPPTPRIFRSKLPDIDIPNHLPLHTYCFEKLSSVSDKPCLIVGSTGKSYTYGETHLICRRVASGLYKLGIRKGDVIMILLQNSAEFVFSFMGASMIGAVSTTANPFYTSQELYKQLKSSGAKLIITHSQYVDKLKNLGENLTLITTDEPTPENCLPFSTLITDDETNPFQETVDIGGDDAAALPFSSGTTGLPKGVVLTHKSLITSVAQQVDGDNPNLYLKSNDVILCVLPLFHIYSLNSVLLNSLRSGATVLLMHKFEIGALLDLIQRHRVTIAALVPPLVIALAKNPTVNSYDLSSVRFVLSGAAPLGKELQDSLRRRLPQAILGQGYGMTEAGPVLSMSLGFAKEPIPTKSGSCGTVVRNAELKVVHLETRLSLGYNQPGEICIRGQQIMKEYLNDPEATSATIDEEGWLHTGDIGYVDEDDEIFIVDRLKEVIKFKGFQVPPAELESLLINHHSIADAAVVPQNDEVAGEVPVAFVVRSNGNDITEEDVKEYVAKQVVFYKRLHKVFFVASIPKSPSGKILRKDLKAKLC

SEQ ID NO: 4102 - protein, 372 aa, Arabidopsis thaliana
MSTNDEENGTVIEVKNVPEPSPETWYSVFLRQASVYGVAAGYCLSASLLSIINKWAIMKFPYPGALTAMQYFTSAAGVLLCAQMKLIEHDSLNLLTMWRFLPAAMIFYLSLFTNSELLLHANVDTFIVFRSAVPIFVAIGETLFLHQPWPSVKTWGSLATIFGGSLLYVFTDYQFTIAAYSWALAYLVSMTIDFVYIKHVVMTIGLNTWGLVLYNNLEALLLFPLELLIMGELKKIKHEITDETDWYSLQVVLPVGLSCLFGLAISFFGFSCRRAISATGFTVLGIVNKLLTVVINLMVWDKHSTFVGTLGLLVCMFGGVMYQQSTIKKPNATQEAKPQEQDEEQEKLLEMQENKESNSVDIKETLKSEEKL

SEQ ID NO: 4103 - protein, 69 aa, Arabidopsis thaliana
VKGHIGLVLLDSNLMYKKWFTPVVHDMFVAALVIMTLLSGVITSLLLRSQEKSFAHIKTSLELFDTTEE

SEQ ID NO: 4104 - protein, 42 aa, Arabidopsis thaliana
KKWFTPVVHDMFVAALVIMTLLSGVITSLLLRSQEKSFAHIK

SEQ ID NO: 4105 - protein, 486 aa, Arabidopsis thaliana
MERSSSSSSSSCDKVWNLGLPYPTFTLANDDKPYLITVSDDHSVKVKNVDWISKLPDDVLLIILSRLSTEEAIRTSVVSKRWEHVWNQMSHLVFDMRKNIINSNNTLDGSNPVATLITQVINNHRGHLESCVIIHVPYQGGNGMLNSWIRLLSCVKRTKVLTLRYHYGTWDRKFKTFNFSPDSLSHPSLMSLSLHSYFLESSHPLRNCSNLRTLKLLSIVAPEIGVFNRVLASCPCLEVLVLGICCFKKSRVPLKIENKKLKLLQVSSLERIDAIEVSTTSLDILAIIDICCRRDDLSLQSPQLQFNRNFWVLGPYVPHISYNISEEKSIGNEEFVNTIYGELLRPFANLYVALSVSVDLMNPTEVERLRQVLGLWTRKILELEIIFKDNNGPREENKSWDKKLWEDNNKKDPFPNAKFRVDTVWMYNFSGSEEEFALMTCLIRQGTVVEKMMIKTSTFPARKRLKIEAAVAKLQALQTKLTIKCF

SEQ ID NO: 4106 - protein, 38 aa, Arabidopsis thaliana
FELPFALVPLLKFTSCKTKMGSHVNPMAITALTWVIGG

SEQ ID NO: 4107 - protein, 32 aa, Arabidopsis thaliana
FALVPLLKFTSCKTKMGSHVNPMAITALTWVI

SEQ ID NO: 4108 - protein, 164 aa, Arabidopsis thaliana
VIIVIVTIAGKFIGVISACMYLKIPKKYWLFLPTILSVKGHVGLLLLDSNYSEKKWWTTTIHDMMVAALVITTLVSGVLASFLLKTREKDFAYEKTSLESHNTNEELRILSCAYGVRHARGAISLVSALSGSRGASDPFTPLLMHLVPLPKKRKSELMYHEHDE

SEQ ID NO: 4109 - protein, 68 aa, Arabidopsis thaliana
KFIGVISACMYLKIPKKYWLFLPTILSVKGHVGLLLLDSNYSEKKWWTTTIHDMMVAALVITTLVSGV

SEQ ID NO: 4110 - protein, 389 aa, Daucus carota
MVTVNEFRKAQRAEGPATVLAIGTATPPNCVDQSAYADYYFRITNSEDKPELKEKFRRMCEKSMINTRYMHLTEDLLKQNPSFCEYMASSLDARQDIVVNEVPKLGKEAALRAIKEWGRPKSKITHLIFCTTSGVDMPGADFRLTKLLGLRPSVKRFMMYQQGCFAGGTVLRLAKDLAENNKNARVLVVCSEITVITFRGPNDTHLDSLVGQALFGDGAGAVIVGSDPVIGIEKPLFEIVSAAQTILPDSDGAIDGHLREVGLTFHLLKDVPGLISKNIRKSLVEAFKPLGISDWNSIFWIAHPGGPAILDQVETELSLKPDKLKSTRQVLRDYGNMSSACVLFILDEMRNASAKDGHRTTGEGLDWGVLFGFGPGLTVETVVLHSVPT

SEQ ID NO: 4111 - protein, 692 aa, Arabidopsis thaliana
MAPRLDFSDWWAKDTRKGTPVVVKMENPNYSVVEIDGPDSAFRPVEKSRGKNAKQVTWVLLLKAHRAVGCLTWLATVFWSLLGAIKKRLSFTHPLGSEKLGRDRWLFTAIKLFLAVSLVILGFEIVAYFRGWHYFQSPSLHIPTSTLEIQSLFHLVYVGWLTLRADYIAPPIKALSKFCIVLFLIQSVDRLVLCLGCFWIKYKKIKPRFDEEPFRNDDAEGSGSEYPMVLVQIPMCNEREVYEQSISAVCQLDWPKDRILVQVLDDSNDESIQQLIKAEVAKWSQKGVNIIYRHRLVRTGYKAGNLKSAMSCDYVEAYEYVAIFDADFQPTPDFLKLTVPHFKDNPELGLVQARWTFVNKDENLLTRLQNINLCFHFEVEQQVNGVFLNFFGFNGTAGVWRIKALEESGGWLERTTVEDMDIAVRAHLHGWKFIYLNDVKVLCEVPESYEAYKKQQHRWHSGPMQLFRLCLGSILTSKIAIWKKANLILLFFLLRKLILPFYSFTLFCIILPLTMFVPEAELPVWVICYIPVFMSFLNLLPSPKSFPFIVPYLLFENTMSVTKFNAMVSGLFQLGSSYEWIVTKKAGRSSESDLLSITEKETPTKKSQLLRGVSDSELLELSQLEEQKQAVSKKPVKKTNKIYHKELALAFLLLTAALRSLLAAQGVHFYFLLFQGVTFLLVGLDLIGEQMS

SEQ ID NO: 4112 - protein, 843 aa, Arabidopsis thaliana
MREEEMESSSEGETNKISRCKATGSDNPDEDYVEITLEVRDETINTMKAKATLRSVLSGRLKTMVKSLSFASRRLDRSKSFGAMFALRGLRFIAKNDAVGRGWDEVAMRFDKLAVEGKLPKSKFGHCIGMVESSEFVNELFEALVRRRGTTSSSITKTELFEFWEQITGNSFDDRLQIFFDMVDKNLDGRITGDEVKEIIALSASANKLSKIKENVDEYAALIMEELDRDNLGYIELHNLETLLLQVPSQSNNSPSSANKRALNKMLSQKLIPTKDRNPVKRFAMNISYFFLENWKRIWVLTLWISICITLFTWKFLQYKRKTVFEVMGYCVTVAKGSAETLKFNMALILLPVCRNTITWLRTKSKLIGSVVPFDDNINFHKVVAFGIAVGIGLHAISHLACDFPRLLHAKNVEFEPMKKFFGDERPENYGWFMKGTDGWTGVTMVVLMLVAYVLAQSWFRRNRANLPKSLKRLTGFNAFWYSHHLFVIVYVLLIVHGYFVYLSKEWYHKTTWMYLAVPVLLYAFERLIRAFRPGAKAVKVLKVAVYPGNVLSLYMSKPKGFKYTSGQYIYINCSDVSPLQWHPFSITSASGDDYLSVHIRTLGDWTSQLKSLYSKVCQLPSTSQSGLFIADIGQANNITRFPRLLIDGPYGAPAQDYRNYDVLLLVGLGIGATPLISIIRDVLNNIKNQNSIERGTNQHIKNYVATKRAYFYWVTREQGSLEWFSEVMNEVAEYDSEGMIELHNYCTSVYEEGDARSALITMLQSLHHAKSGIDIVSGTRVRTHFARPNWRSVFKHVAVNHVNQRVGVFYCGNTCIIGELKRLAQDFSRKTTTKFEFHKENF

SEQ ID NO: 4113 - protein, 98 aa, Arabidopsis thaliana
LFTWKFLQYKRKTVFEVMGYCVTVAKGSAETLKFNMALILLPVCRNTITWLRTKSKLIGSVVPFDDNINFHKVVAFGIAVGIGLHAISHLACDFPRLL

SEQ ID NO: 4114 - protein, 95 aa, Arabidopsis thaliana
CVTVAKGSAETLKFNMALILLPVCRNTITWLRTKSKLIGSVVPFDDNINFHKVVAFGIAVGIGLHAISHLACDFPRLLHAKNVEFEPMKKFFGDE

SEQ ID NO: 4115 - protein, 98 aa, Arabidopsis thaliana; identical to SEQ ID NO: 4113

SEQ ID NO: 4116 - protein, 95 aa, Arabidopsis thaliana; identical to SEQ ID NO: 4114

SEQ ID NO: 4117 - protein, 496 aa, Arabidopsis thaliana
MAKPEEVSVPIFTSLEPVYGEGSLLQEATQRFDVLKANFNDVFGASPQLFARSPGRVNLIGEHIDYEGYSVLPMAIRQDTIIAIRKCEDQKQLRIANVNDKYTMCTYPADPDQEIDLKNHKWGHYFICAYKGFHEYAKSKGVNLGSPVGLDVLVDGIVPTGSGLSSSAAFVCSATIAIMAVFGHNFEKKELAQLTCECERHIGTQSGGMDQAISIMAKTGFAELIDFNPVRATDVKLPDGGSFVIAHSLAESQKAVTAAKNYNNRVVECRLASIILGVKLGMEPKEAISKVKTLSDVEGLCVSFAGDRGSSDPLLAVKEYLKEEPYTAEEIEKILEEKLPSIVNNDPTSLAVLNAATHFKLHQRAAHVYSEARRVHGFKDTVNSNLSDEEKLKKLGDLMNESHYSCSVLYECSCPELEELVQVCKENGALGARLTGAGWGGCAVALVKEFDVTQFIPAVKEKYYKKRVEKGVVKKEDMELYLFASKPSSGAAIFNL

SEQ ID NO: 4118 - protein, 497 aa, Nicotiana tabacum
MKKATVGAAVIGAATVCAVAALIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVNEEGEKFQQPPGKQRELGFTFSFPVMQTSINSGTIMRWTKGFSIDDAVGQDVVGELAKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEEAGIFGDEVPPKLKSPFVLRTPDMSAMHHDASSDLRVVGDKLKDILEISNTSLKTRRLVIELCNIVATRGARLAAAGVLGILKKMGRDTPRQGGLEKTVVAMDGGLYEHYTEYRMCLENTLKELLGDELATSIVFEHSNDGSGIGAALLAASNSMYLEDKS

SEQ ID NO: 4119 - protein, 498 aa, Spinacia oleracea
MRKAAVGAAVVCTAAVCAAAAVLVRQRMKSSSKWGRVMAILKELDDNCGTPLGKLRQVADAMTVEMHAGLASEGASKLKMLISYVDNLPTGDEHGLFYALDLGGTNFRVLRVKLGGKEKRVVEQEFDEVSIPPELMVGTSEQLFDYIAEALAKFVATESEGLHPEPNKQRELGFTFSFPVKQTSIASGTLIRWTKGFNIEDTVGEDVVAELTKAMLRKGVDMRVTALVNDTVGTLAGGRYYKEDVIAAVILGTGTNAAYVERASAIHKWHGPLPKSGEMVINMEWGNFRSSYLPLTEYDIALDEESLNPGEQIFEKMISGMYLGEIVRRVLYRMADEASLFGDTVPSKLKTPFILRTPDMSAMHHDTSPDLKVVASKLKDVLGIPNSSLKVRKIIVDVCDVIASRGACISAAGILGIIKKLGRDTLKQGENQKSVIALDGGLFEHYAKFRECMEDSLKELLGDEVAETIVIEHSNDGSGIGAALLAASHSQYLEEDES

SEQ ID NO: 4120 - protein, 194 aa, Arabidopsis thaliana
MAIVSPNFCAPYPIELGIVRKVMTLTDGNFAVTDVNGNLLFKVKEPLFSISDKRILLDAYDTPILTLRENKVSLHDRWLVYRGKSTDQSDLLYTLKRSSMIQIMKPKLDIFLAHNKEMKICDFHVKGSWIDRSCVVYAGKSDAIVAQMHKKHTAQSILIGKSNFSVTVYPNVDFAFIVSLIVILDDINREDSED

SEQ ID NO: 4121 - protein, 500 aa, Arabidopsis thaliana
MRRSIVIVIALTAKGFLHRHLLEKGNLVTALSLRICNSRAFSGRSDYRERLRSGLHSIKFNDALTLFCDMAESHPLPSIVDFSRLLIAIAKLNKYEAVISLFRHLEMLGISHDLYSFTTLIDCFCRCARLSLALSCLGKMMKLGFEPSIVTFGSLVNGFCHVNRFYEAMSLVDQIVGLGYEPNVVIYNTIIDSLCEKGQVNTALDVLKHMKKMGIRPDVVTYNSLITRLFHSGTWGVSARILSDMMRMGISPDVITFSALIDVYGKEGQLLEAKKQYNEMIQRSVNPNIVTYNSLINGLCIHGLLDEAKKVLNVLVSKGFFPNAVTYNTLINGYCKAKRVDDGMKILCVMSRDGVDGDTFTYNTLYQGYCQAGKFSAAEKVLGRMVSCGVHPDMYTFNILLDGLCDHGKIGKALVRLEDLQKSKTVVGIITYNIIIKGLCKADKVEDAWYLFCSLALKGVSPDVITYITMMIGLRRKRLWREAHELYRKMQKEDGLMPIK

SEQ ID NO: 4122 - protein, 87 aa, Arabidopsis thaliana
NTLYQGYCQAGKFSAAEKVLGRMVSCGVHPDMYTFNILLDGLCDHGKIGKALVRLEDLQKSKTVVGIITYNIIIKGLCKADKVEDAW

SEQ ID NO: 4123 - protein, 77 aa, Arabidopsis thaliana
VHPDMYTFNILLDGLCDHGKIGKALVRLEDLQKSKTVVGIITYNIIIKGLCKADKVEDAWYLFCSLALKGVSPDVIT

SEQ ID NO: 4124 - protein, 127 aa, Arabidopsis thaliana
SMKKLDETVLLQVLRDGKEHEFHIMVKPVPPLVPGHQYDKLPSYYIFAGFVFVPLTQPYIDSTLICNCAIKYMPEKAGEQLVLADDINAGYTDFKNLKVIKVNGVQVENLKHLTELVETCWTEDLRL

SEQ ID NO: 4125 - protein, 111 aa, Arabidopsis thaliana
HIMVKPVPPLVPGHQYDKLPSYYIFAGFVFVPLTQPYIDSTLICNCAIKYMPEKAGEQLVLADDINAGYTDFKNLKVIKVNGVQVENLKHLTELVETCWTEDLRLDLENEK

SEQ ID NO: 4126 - protein, 786 aa, Arabidopsis thaliana
MDAPVPLSLSTLLELCTNLLQKSVNKSNGRFTAQLVHCRVIKSGLMFSVYLMNNLMNVYSKTGYALHARKLFDEMPLRTAFSWNTVLSAYSKRGDMDSTCEFFDQLPQRDSVSWTTMIVGYKNIGQYHKAIRVMGDMVKEGIEPTQFTLTNVLASVAATRCMETGKKVHSFIVKLGLRGNVSVSNSLLNMYAKCGDPMMAKFVFDRMVVRDISSWNAMIALHMQVGQMDLAMAQFEQMAERDIVTWNSMISGFNQRGYDLRALDIFSKMLRDSLLSPDRFTLASVLSACANLEKLCIGKQIHSHIVTTGFDISGIVLNALISMYSRCGGVETARRLIEQRGTKDLKIEGFTALLDGYIKLGDMNQAKNIFVSLKDRDVVAWTAMIVGYEQHGSYGEAINLFRSMVGGGQRPNSYTLAAMLSVASSLASLSHGKQIHGSAVKSGEIYSVSVSNALITMYAKAGNITSASRAFDLIRCERDTVSWTSMIIALAQHGHAEEALELFETMLMEGLRPDHITYVGVFSACTHAGLVNQGRQYFDMMKDVDKIIPTLSHYACMVDLFGRAGLLQEAQEFIEKMPIEPDVVTWGSLLSACRVHKNIDLGKVAAERLLLLEPENSGAYSALANLYSACGKWEEAAKIRKSMKDGRVKKEQGFSWIEVKHKVHVFGVEDGTHPEKNEIYMTMKKIWDEIKKMGYVPDTASVLHDLEEEVKEQILRHHSEKLAIAFGLISTPDKTTLRIMKNLRVCNDCHTAIKFISKLVGREIIVRDTTRFHHFKDGFCSCRDYW

SEQ ID NO: 4127 - protein, 385 aa, Arabidopsis thaliana
MELGKSIENHNDVVVRLTKHVIATVANGSNLVFSPISINVLLSLIAAGSCSVTKEQILSFLMLPSTDHLNLVLAQIIDGGTEKSDLRLSIANGVWIDKFFSLKLSFKDLLENSYKATCSQVDFASKPSEVIDEVNTWAEVHTNGLIKQILSRDSIDTIRSSTLVLANAVYFKGAWSSKFDANMTKKNDFHLLDGTSVKVPFMTNYEDQYLRSYDGFKVLRLPYIEDQRQFSMYIYLPNDKEGLAPLLEKIGSEPSFFDNHIPLHCISVGAFRIPKFKFSFEFNASEVLKDMGLTSPFNNGGGLTEMVDSPSNGDDLYVSSILHKACIEVDEEGTEAAAVSVGVVSCTSFRRNPDFVADRPFLFTVREDKSGVILFMGQVLDPSKH

SEQ ID NO: 4128 - protein, 462 aa, Arabidopsis thaliana
MSEEQPHANLAVPAFKTEKEPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWMRITIGVEAHMLEDALERLKGFCTRHAKKTETETESLQALKLSDNNLEM

SEQ ID NO: 4129 - protein, 891 aa, Arabidopsis thaliana
MAPTQDPNSVGGGAKKDEATLKVPSKDPKKKDEKKDEDLSEEDLELKQNLELYVERVQDPNPELQKAALESMRQEIRASTSSMTSVPKPLKFLRPHYGTLKAFHETMADSDLKKYLSDILSVLALTMSADGERESLRFRLIGTEGDIGSWGHEYVRNLAGEIAQEYTKRQSEEASIDDLMELVQQIVAFHMKHNAETEAVDLLMDVEDLDLLLEHVDKTNFKRTCNYLTSAARYLPGPDDMLVLDISYMIYMKFEEYPNALQIALFLDNTQYVKQVFTSCTDLLKKKQFCYMIARHGITFELDDEMVADDDDREALQDIVNNTKLSEGYLTLARDIEVMEAKTPEDIYKAHLLDGRASSGASVDSARQNLAATFVNAFVNAGFGQDKLMTVPSDSTTGSSGNWLFKNKEHGKTSAAASLGMIQLWDVDSGLSQLDKYFHSNDNPIIAGALLGVGIVNCGIKNDCDPALALLGDYIDKEDSSVRIGAIMGLGISYAGSQNDQIRNKLSPILNDAKAPLDVIAFASLSLGMIYVGSCNEEVAQSIIFALMDRSEAELGDALTRFLPLGLGLLYLGKQESVEATAEVSKTFNEKIRKYCDMTLLSCAYAGTGNVLKVQDLLAQCGEHLEKGDIHQGPAVLGLAMVAMSEELGVDMEIRSLERMLQYGEQNIRRAVPLALGLLCISNPKVTVMDTLSRLSHDTDSEVAMSAIISLGLIGAGTNNARIAGMLRNLSSYYYKDMSLLFCVRIAQGLVHMGKGLLTLSPFHSERFLLSPTALAGIVTLLHACLDMKPIILGKYHYVLYFLVLAMQPRMMLTVDENLKPLSVPVRVGQAVDVVGQAGRPKTITGFQTHSTPVLLAAGERAELATDKYIPLSPILEGFIILKENPDYREE

SEQ ID NO: 4130 - protein, 512 aa, Arabidopsis thaliana
MEAANEPVNGGSVQIRTENNERRKLPNFLQSVNMKYVKLGYHYLITHLFKLCLVPLMAVLVTEISRLTTDDLYQIWLHLQYNLVAFIFLSALAIFGSTVYIMSRPRSVYLVDYSCYLPPESLQVKYQKFMDHSKLIEDFNESSLEFQRKILERSGLGEETYLPEALHCIPPRPTMMAAREESEQVMFGALDKLFENTKINPRDIGVLVVNCSLFNPTPSLSAMIVNKYKLRGNVKSFNLGGMGCSAGVISIDLAKDMLQVHRNTYAVVVSTENITQNWYFGNKKAMLIPNCLFRVGGSAILLSNKGKDRRRSKYKLVHTVRTHKGAVEKAFNCVYQEQDDNGKTGVSLSKDLMAIAGEALKANITTLGPLVLPISEQILFFMTLVTKKLFNSKLKPYIPDFKLAFDHFCIHAGGRAVIDELEKNLQLSQTHVEASRMTLHRFGNTSSSSIWYELAYIEAKGRMKKGNRVWQIAFGSGFKCNSAVWVALNNVKPSVSSPWEHCIDRYPVKLDF

SEQ ID NO: 4131 - protein, 589 aa, Arabidopsis thaliana
MAISVQHVVVLLLSTLLIAITFFLFTSDNARFPFPSLSTTDYYTPIPKSPIPHRIVDVSSDQTPQKMKLNTSLEVGELKWDLCKGAESVDYIPCLDNYAAIKQLKSRRHMEHRERHCPEPSPKCLLPLPDNYKPPVPWPKSRDMIWYDNVPHPKLVEYKKEQNWVKKEGEFLVFPGGGTQFKFGVTHYVEFIEKALPSIKWGKNIRVVLDVGCGVASFGGSLLDKDVITMSFAPKDEHEAQIQFALERGIPATLSVIGTQQLTFPSNAFDLIHCARCRVHWDADGGKPLLELNRVLRPGGFFIWSATPVYRDNDRDSRIWNEMVSLTKSICWKVVTKTVDSSGIGLVIYQKPTSESCYNKRSTQDPPLCDKKEANGSWYVPLAKCLSKLPSGNVQSWPELWPKRLVSVKPQSISVKAETLKKDTEKWSASVSDVYLKHLAVNWSTVRNVMDMNAGFGGFAAALINLPLWVMNVVPVDKPDTLSVVYDRGLIGVYHDWCESVNTYPRTYDLLHSSFLLGDLTQRCEIVQVVAEIDRIVRPGGYLVVQDNMETIMKLESILGSLHWSTKIYEDRFLVGRKGFWRPAKPELR

SEQ ID NO: 4132 - protein, 95 aa, Arabidopsis thaliana
AEKGDMDIAVVYFSKTRQLCMKIDAVALVGILHGCKKSSHIDIGMSLHGYAIKSGLCTKTLVVNGLITMYSKFDDVETVLFLFEQLQETPLISWN

SEQ ID NO: 4133 - protein, 85 aa, Arabidopsis thaliana
VVYFSKTRQLCMKIDAVALVGILHGCKKSSHIDIGMSLHGYAIKSGLCTKTLVVNGLITMYSKFDDVETVLFLFEQLQETPLISW

SEQ ID NO: 4134 - protein, 283 aa, Arabidopsis thaliana
MDNEDQESLLLQGVPDNYGGVKVNLTEPMTIEDFVPKLRASLVYWSNQGTKGIWLKLADGLDNLIAPAKAEGFVCHHAEREYTMLTSWIADVPSTLPANASHRIGVGAFVLNKKTKEVLVVQEIDGHFKGTGVWKLPTGVVKEGENIWEGALREVEEETGIKTKFVEVLAFRESHQAFLEIKTDIFFLCELEPTTFEIKKQDSEILAAKWMPIEEYVNQPWNQKKELFRFMANICLKRLQEMEYMGFSKVLTTTSSGKESYLYCNTDHANLLNATRGLASTSG

SEQ ID NO: 4135 - protein, 501 aa, Arabidopsis thaliana
MEKVREIVREGRRVGKEDPRRVVHAFKVGLALALVSSFYYYQPLYDNFGVNAMWAVMTVVVVFEFSVGATLGKGLNRAVATLVAGGLGIGAHHLASLSGPTVEPILLAIFVFVLAALSTFVRFFPRVKARYDYGVLIFILTFALISVSGFREDEILDLAHKRLSTVIMGGVSCVLISIFVCPVWAGQDLHSLLASNFDTLSHFLQEFGDEYFEATEDGDIKEVEKRRRNLERYKSVLNSKSNEEALANFAKWEPRHGQFRFRHPWRQYLAVGALLRQSAYRIDALNSNINSDMQIPMDIKKKIEEPLRRMSSESGKSMKEVSISLKNMTISSSFDIHVVNSQSACKTLSTLLKSGILNDVEPLQMISLMTTVSLLIDIVNLTEKISESVHELASAAKFKNKKKPSKSNSGSIGQAMPNKSHDDDDHVVTILGDVDTSNNVDQSQSHGEISVDSCHHVTIKINDDDSIHDKNEDGDIHVHTNRVSCDHTNASDLLDSGVKKN

SEQ ID NO: 4136 - protein, 1082 aa, Arabidopsis thaliana
MRVRVDVCWTQHIFLFFVFGLSFMSFALSLDGDDYSKTGNPKALVSVTNLIYTRLQNLKTVLKADVDRDLGYCIKNLKGDWNEAFNFDKNLDFLSNCVKKNDGDLTLRLCSAAEIKFYFSSFVRRDEATTVHVKPNINCNLAKWVSGCEPGWSCNADDEKRFDLNNGKILPSRTRKCQPCCEGFFCPQGLACMIPCPLGAYCPLAKLNKTTGFCEPYNYQIPPGKLNHTCGSADSWVDAESSGDMFCSPGSYCPTTIRKVTCSSGHYCRQGSTSQKPCFKLATCNPNTANQNIHAYGAILIASLSLLMIMVYNCSDQVLATREKRQAKSREAAARHAKETTQARERWKTAKGVAKNQKMGLSAQLSQTFSRMKSARKDATPVKASGKSKDKKKEPSNLTKMMKSMEENPSNNEGFNVGTGSKPGKKPQAPKGKQLHTQSQIFKYAYGQIEKEKAMEQNNKNLTFSGVISMATDTEMRTRPVIEVAFKDLTLTLKGKHKHILRSVTGKIMPGRVSAVMGPSGAGKTTFLSALAGKATGCTRTGLILINGRNDSINSYKKITGFVPQDDVVHGNLTVEENLRFSARCRLSAYMSKADKVLIIERVIESLGLQHVRDSLVGTIEKRGISGGQRKRVNVGVEMVMEPSLLILDEPTTGLDSASSQLLLRALRREALEGVNICMVVHQPSYTMYKMFDDMIILAKGGLTVYHGSVKKIEEYFADIGITVPDRVNPPDHYIDILEGIVKPDGDITIEQLPVRWMLHNGYPVPHDMLKFCDGLPSSSTGSAQEDSTHNSFSNDLWQDVKTNVEITKDQLQHNYSNSHDNSNRVTPTVGRQYRYFVGRVGKQRLREARLQALDFLILLVAGACLGTLAKVNDETIDTLGYTYTIIAVSLLCKISALRSFSVDKLQYWRESAAGISSLAHFMAKDTMDHLNTIMKPLVYLSMFYFFNNPRSSFEDNYIVLVCLVYCVTGMAYIFAILYSPSAAQLLSVLVPVVMTLIANQDKESMVLKYLGSFCYPKWTLEAFVLSNAQRYSGVWVVTRCSSLSQNGYDLSDWILCLIVLVLMGLICRFIAYFCMVTFQKK

SEQ ID NO: 4137 - protein, 336 aa, Arabidopsis thaliana
MDCGMENCNGGISNGDVLGKHEKLIIDTDPGIDDSMAILMAFQTPELEILGLTTVFGNVSTQDATRNALLLCEIAGFPDVPVAEGSSEPLKGGIPRVADFVHGKNGLGDVSLPPPSRKKSEKSAAEFLDEKVEEYPGEVTILALGPLTNLALAIKRDSSFASKVKKIVILGGAFFSLGNVNPAAEANIYGDPEAADVVFTSGADITVVGINITTQLKLSDDDLLELGNCKGKHSKLISDMCKFYRDWHVKSDGVYGVYLHDPVSFVAVVRPDLFTYKKGVVRVETQGICVGHTLMDQGLKRWNGSNPWVGYSPISVAWTVDVEGVLEYVKAKLMKP

SEQ ID NO: 4138 - protein, 57 aa, Arabidopsis thaliana
EAADVVFTSGADITVVGINITTQLKLSDDDLLELGNCKGKHSKLISDMCKFYRDWHV

SEQ ID NO: 4139 - protein, 55 aa, Arabidopsis thaliana
ITVVGINITTQLKLSDDDLLELGNCKGKHSKLISDMCKFYRDWHVKSDGVYGVYL

SEQ ID NO: 4140 - protein, 700 aa, Arabidopsis thaliana
MATQQQQSAIKGAKVLMVGAGGIGCELLKTLALSGFEDIHIIDMDTIEVSNLNRQFLFRRSHVGQSKAKVARDAVLRFRPNINIRSYHANVKNPEFDVDFFKQFDVVLNGLDNLDARRHVNRLCLAADVPLVESGTTGFLGQVTVHIKGKTECYECQTKPAPKTYPVCTITSTPTKFVHCIVWAKDLLFAKLFGDKNQDNDLNVRSNNSASSSKETEDVFERSEDEDIEQYGRKIYDHVFGSNIEAALSNEETWKNRRRPRPIYSKDVLPESLTQQNGSTQNCSVTDGDLMVSAMPSLGLKNPQELWGLTQNSLVFIEALKLFFAKRKKEIGHLTFDKDDQLAVEFVTAAANIRAESFGIPLHSLFEAKGIAGNIVHAVATTNAIIAGLIVIEAIKVLKKDVDKFRMTYCLEHPSKKLLLMPIEPYEPNPACYVCSETPLVLEINTRKSKLRDLVDKIVKTKLGMNLPLIMHGNSLLYEVGDDLDDIMVANYNANLEKYLSELPSPILNGSILTVEDLQQELSCKINVKHRFFSEILNPVLNSVWFLIILPSTFPKLFHFTESRNQDGLSLDIILGFSNVTIRRVLTMFETGRRLTHPLLILFCHREEFDEEKEPEGMVLSGWTPSPATNGESASTSNNENPVDVTESSSGSEPASKKRRLSETEASNHKKETENVESEDDDIMEVENPMMVSKKKIRVE

SEQ ID NO: 4141 - protein, 625 aa, Arabidopsis thaliana
MATQQQQSAIKGAKVLMVGAGGIGCELLKTLALSGFEDIHIIDMDTIEVSNLNRQFLFRRSHVGQSKAKVARDAVLRFRPNINIRSYHANVKNPEFDVDFFKQFDVVLNGLDNLDARRHVNRLCLAADVPLVESGTTGFLGQVTVHIKGKTECYECQTKPAPKTYPVCTITSTPTKFVHCIVWAKDLLFAKLFGDKNQDNDLNVRSNNSASSSKETEDVFERSEDEDIEQYGRKIYDHVFGSNIEAALSNEETWKNRRRPRPIYSKDVLPESLTQQNGSTQNCSVTDGDLMVSAMPSLGLKNPQELWGLTQNSLVFIEALKLFFAKRKKEIGHLTFDKDDQLAVEFVTAAANIRAESFGIPLHSLFEAKGIAGNIVHAVATTNAIIAGLIVIEAIKVLKKDVDKFRMTYCLEHPSKKLLLMPIEPYEPNPACYVCSETPLVLEINTRKSKLRDLVDKIVKTKLGMNLPLIMHGNSLLYEVGDDLDDIMVANYNANLEKYLSELPSPILNGSILTVEDLQQELSCKINVKHREEFDEEKEPEGMVLSGWTPSPATNGESASTSNNENPVDVTESSSGSEPASKKRRLSETEASNHKKETENVESEDDDIMEVENPMMVSKKKIRVE

SEQ ID NO: 4142 - protein, 199 aa, Arabidopsis thaliana
EVVKKSSLPIPTDAIFYAGTGNLLCRSEDKVVIFDLQQRLVLGELQTPFVRYVVWSNDMESVALLSKHTIIIASKKLVLQCTLHETIRVKSGAWDDNGVFIYTTLNHIKYCLPNGDSGIIRTLDVPIYITKVSGNTIFCLDRDGKNRAITINATEYIFKLALLRKKYDHVMSMIKNSQLCGQAMIAYLQQKGFPEVALH

SEQ ID NO: 4143 - protein, 35 aa, Arabidopsis thaliana
FVRYVVWSNDMESVALLSKHTIIIASKKLVLQCTL

SEQ ID NO: 4144 - protein, 388 aa, Arabidopsis thaliana
MDKTFFSSNEGKPITCKAAICRKAGEALVIEDIHVDPPQAYEVRIKILCTSLCHTDLTFWKLSFGPISRFPRILGHEAVGVVESIGENVDGFKQGDVVLPVFHPYCEECKDCKSSKTNWCDRYAEDFISNTRRYGMASRFKDSSGEVIHHFLFVSSFSEYTVVDIAHLVKISPEIPVDKAALLSCGVSTGIGAAWKVANVEEGSTIAIFGLGAVGLAVAEGARLRGAAKIIGIDTNSDKFELGKKFGFTDFINPTLCGEKKISEVIKEMTEGGVDYSFECVGLASLLNEAFISTRTGTGKTVMLGMEKHAAPISLGSFDLLRGRVICGSLFGGLKSKLDIPILVDHYLKKELNLDSFITHELNFKEINKAFALLEEGKSLRCILWMDK

SEQ ID NO: 4145 - protein, 386 aa, Arabidopsis thaliana
MDKASITEGKPIRCKAAILRKAGEPLVIEEIQVDPPQAYEVRIKILCTSLCHTDVTFWKLDSGPLARFPRILGHEAVGVVESIGEKVDGFKQGDVVLPVFHPQCEECKECISPKSNWCTKYTNDYLSNTRRYGMTSRFKDSRGEDIHHFIFVSSFTEYTVVDIAHLVKISPEIPVDIAALLSCSVATGLGAAWKVADVEEGSTVVIFGLGAVGLAVAEGVRLRGAAKIIGVDLNPAKFEIGKRFGITDFVNPALCGEKTISEVIREMTDVGADYSFECIGLASLMEEAFKSTRPGSGKTIVLGMEQKALPISLGSYDLLRGRTVCGTLFGGLKPKLDIPILVDRYLKKELNLEDLITHELSFEEINKAFHLLAEGNSIRCIIWMDK

SEQ ID NO: 4146 - protein, 347 aa, Arabidopsis thaliana
MGKGRALSDGVIKKIILSYTYVAIWIFLSFTVIVYNKYILDKKMYNWPFPITLTMIHMGFCSSLAVILIKVFKVVEPVSMSRETYLRSVVPIGALYSLSLWLSNSAYIYLSVSFIQMLKALMPVAVYSIGVLLKKETFKSQTMTNMLSISFGVAIAAYGEAKFDGWGVFLQLGAVAFEATRLVLIQILLTSKGINLNPITSLYYVAPCCLVFLSVPWIFVEFPVLRDTSSFHFDFVIFGTNSVCAFALNLAVFLLVGKTSALTMNVAGVVKDWLLIAFSWSVIKDTVTPINLFGYGLAFLGVGYYNHCKLQALKAKDAQKKVQASDDEAGKLLEERESEAKRNETQD

SEQ ID NO: 4147 - protein, 339 aa, Arabidopsis thaliana
MKTKNVKLLFFFFSVSLLLIAVVNAAEGHSHGGPKCECSHEDDHENKAGARKYKIAAIPTVLIAGIIGVLFPLLGKVFPSLRPETCFFFVTKAFAAGVILATGFMHVLPEAYEMLNSPCLTSEAWEFPFTGFIAMIAAILTLSVDTFATSSFYKSHCKASKRVSDGETGESSVDSEKVQILRTRVIAQVLELGIIVHSVVIGISLGASQSPDAAKALFIALMFHQCFEGLGLGGCIAQGKFKCLSVTIMSTFFAITTPIGIVVGMGIANSYDESSPTALIVQGVLNAASAGILIYMSLVDLLAADFTHPKMQSNTGLQIMAHIALLLGAGLMSLLAKWA

SEQ ID NO: 4148 - protein, 482 aa, Arabidopsis thaliana
MTKKSGVLILGAGRVCRPAADFLASVRTISSQQWYKTYFGADSEEKTDVHVIVASLYLKDAKETVEGISDVEAVRLDVSDSESLLKYVSQVDVVLSLLPASCHAVVAKTCIELKKHLVTASYVDDETSMLHEKAKSAGITILGEMGLDPGIDHMMAMKMINDAHIKKGKVKSFTSYCGGLPSPAAANNPLAYKFSWNPAGAIRAGQNPAKYKSNGDIIHVDGKNLYDSAARFRVPNLPAFALECFPNRDSLVYGEHYGIESEATTIFRGTLRYEGFSMIMATLSKLGFFDSEANQVLSTGKRITFGALLSNILNKDADNESEPLAGEEEISKRIIKLGHSKETAAKAAKTIVFLGFNEEREVPSLCKSVFDATCYLMEEKLAYSGNEQDMVLLHHEVEVEFLESKRIEKHTATLLEFGDIKNGQTTTAMAKTVGIPAAIGALLLIEDKIKTRGVLRPLEAEVYLPALDILQAYGIKLMEKAE

SEQ ID NO: 4149 - protein, 496 aa, Apium graveolens
MAGSGVYADIIEGDVFKYYSDGEWKKSSSGKSVAIINPTTRMTQFKVQACTQEEVNKAMETAKKVQKQWAKTPLWKRAELLHKAAAILKEHKAAIADCLVKEIAKPAKDSVTEVVRSGDLVSYCAEEGVRLLGEGKFLVSDSFPGNERTKYCLTSKIPLGVILAIPPFNYPVNLAVSKIGPALIAGNALVLKPPTQGAVACLHMVHCFHLAGFPKGLISCITGKGSEIGDFLTMHPGVNCISFTGGDTGIAISKKAGMVPLQMELGGKDACIVLEDADLDLVASNVIKGGFSYSGQRCTAIKVILVMQSVADTLVEKVNAKVAKLTVGPPEDNSDITPVVSESSANFIEGLVKDAKEKGATFCQEYKREGNLIWPLLLDNVKPDMRIAWEEPFGPILPVIRINSAEEGIHHCNASNFGLQGCVFTRDINKAMLISDAMESGTIQINSAPARGPDHFPFQGLKDSGIGSQGITNSINMMTKIKTTVINLPSPSYTMG

SEQ ID NO: 4150 - protein, 191 aa, Apium graveolens
TQFKVQACTQEEVNKAMETAKKVQKQWAKTPLWKRAELLHKAAAILKEHKAAIADCLVKEIAKPAKDSVTEVVRSGDLVSYCAEEGVRLLGEGKFLVSDSFPGNERTKYCLTSKIPLGVILAIPPFNYPVNLAVSKIGPALIAGNALVLKPPTQGAVACLHMVHCFHLAGFPKGLISCITGKGSEIGDFLT

SEQ ID NO: 4151 - protein, 184 aa, Apium graveolens
VQKQWAKTPLWKRAELLHKAAAILKEHKAAIADCLVKEIAKPAKDSVTEVVRSGDLVSYCAEEGVRLLGEGKFLVSDSFPGNERTKYCLTSKIPLGVILAIPPFNYPVNLAVSKIGPALIAGNALVLKPPTQGAVACLHMVHCFHLAGFPKGLISCITGKGSEIGDFLTMHPGVNCISFTGGDT

SEQ ID NO: 4152 - protein, 485 aa, Lupinus luteus
MALLVEKTTSGREYKVKDMSQADFGRLEIELAEVEMPGLMASRSEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEEIYEKSGQFPDPDSTDNAEFKIVLSIIKEGLKTDPKRYHKMKDRVVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQATMEGLQVLTLEDVVSEADIFVTTTGNKDIIMLDHMKKMKNNAIVCNIGHFDNEIDMLGLETHPGVKRITIKPQTDRWVFPETNTGIIILAEGRLMNLGCATGHPSFVMSCSFTNQVIAQLELWNEKSSGKYEKKVYVLPKHLDEKVAALHLEKLGAKLTKLSKDQADYISVPVEGPYKPFHYRY

SEQ ID NO: 4153 - protein, 496 aa, Solanum tuberosum
MKKATVGAVVVGTAAAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTNSLNPGEQIFEKICSGMYLGEILRRVLLRMAEEAGIFGEEVPPKLKNSFILRTPEMSAMHHDTSSDLRVVGDKLKDILEISNSSLKTRRLVVELCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 4154 - protein, 347 aa, Arabidopsis thaliana
MEKPESEKKSAVSDVGAWAMNVISSVGIIMANKQLMSSSGFGFGFATTLTGFHFAFTALVGMVSNATGLSASKHVPLWELLWFSIVANISIAAMNFSLMLNSVGFYQISKLSMIPVVCVLEWILHSKHYCKEVKASVMVVVIGVGICTVTDVKVNAKGFICACTAVFSTSLQQISIGSLQKKYSVGSFELLSKTAPIQAISLLICGPFVDYLLSGKFISTYQMTYGAIFCILLSCALAVFCNISQYLCIGRFSATSFQVLGHMKTVCVLTLGWLLFDSEMTFKNIAGMAIAIVGMVIYSWAVDIEKQRNAKSTPHGKHSMTEDEIKLLKEGVEHIDLKDVELGDTKP

SEQ ID NO: 4155 - protein, 162 aa, Arabidopsis thaliana
MAPITVGDVVPDGTISFFDENDQLQTVSVHSIAAGKKVILFGVPGAFTPTCSMSHVPGFIGKAEELKSKGIDEIICFSVNDPFVMKAWGKTYPENKHVKFVADGSGEYTHLLGLELDLKDKGLGIRSRRFALLLDNLKVTVANVESGGEFTVSSAEDILKAL

SEQ ID NO: 4156 - protein, 459 aa, Arabidopsis thaliana
MFIAMADFKLLLLILILLSLFELDLLHFHHDFFSPFPVKIGLLLISIFFYAYSTTRSKPVYLVDFSCHQPTDSCKISSETFFNMAKGAQLYTEETIQFMTRILNRSGLGDDTYSPRCMLTSPPTPSMYEARHESELVIFGALNSLFKKTGIEPREVGIFIVNCSLFNPNPSLSSMIVNRYKLKTDVKTYNLSGISVDLATNLLKANPNTYAVIVSTENMTLSMYRGNDRSMLVPNCLFRVGGAAVMLSNRSQDRVRSKYELTHIVRTHKGSSDKHYTCAEQKEDSKGIVGVALSKELTVVAGDTLKTNLTALGPLVLPLSEKLRFILFLVKSKLFRLKVSPYVPDFKLCFKHFCIHAGGRALLDAVEKGLGLSEFDLEPSRMTLHRFGNTSSSSLWYELAYVEAKCRVKRGDRVWQLAFGSGFKCNSIVWRALRTIPANESLVGNPWGDSVHKYPVHVT

SEQ ID NO: 4157 - protein, 490 aa, Arabidopsis thaliana
MMMMIILLWSIIFMTILFLKKQLSGKKGKTPPSPPGLPLIGNLHQLGRHTHRSLCDLSRRYGPLMLLHLGRVPVLIVSSADMAQEILKTHDQAFANRPRSKLSQKLLYNNRDVASAPYGEYWRQMKSVCVIHLLSNKMVRSFRDVREEEITLMMAKIRKSSSLPFNVSKVLECLTNDVICRVALGRKYGGETDFKKLTDRLSELLGTFSIGSFVPWLAWVDWIRGWDAQLDKMGKDLDDFFEKVVQDHEDGDRRDGTDLIDALLRVKREKSPGFEIERVSIKAITLDVFVGGSDTSFTLLEWAMTELLRHPKSLNRLQEEVRTICKGKSRVSEDDIQGMKYLKAVIKEALRLHPPFPMMAPHESTEDVKLRDYHIPAGTQVMMNAWAIGREVATWGPDAEEFKPERHLDTSVDFRGQNFELLPFGAGRRICPAVSFAVVLNEVVLANLVHGFDWKLPEESKEDKTDVAESSGFSVHREFPLYAVASPYLT

SEQ ID NO: 4158 - protein, 450 aa, Arabidopsis thaliana
MVVRKVGKYELGRTIGEGTFAKVKFAQNTETGESVAMKIVDRSTIIKRKMVDQIKREISIMKLVRHPCVVRLYEVLASRTKIYIILEYITGGELFDKIVRNGRLSESEARKYFHQLIDGVDYCHSKGVYHRDLKPENLLLDSQGNLKISDFGLSALPEQGVTILKTTCGTPNYVAPEVLSHKGYNGAVADIWSCGVILYVLMAGYLPFDEMDLPTLYSKIDKAEFSCPSYFALGAKSLINRILDPNPETRITIAEIRKDEWFLKDYTPVQLIDYEHVNLDDVYAAFDDPEEQTYAQDGTRDTGPLTLNAFDLIILSQGLNLATLFDRGKDSMKHQTRFISHKPANVVLSSMEVVSQSMGFKTHIRNYKMRVEGLSANKTSHFSVILEQETQKNTLSSTRLFVVSLMTSFGSRQMHLKFYKTFCSKLDDIIWKPPDASMRNRVTKAKSKRR

SEQ ID NO: 4159 - protein, 82 aa, Arabidopsis thaliana
DDGLTEISSPGKSGSIFYLSHDDRFVIKTLKKSELQVLLRMLPKYYEHVGDHENTLITKFFGVHRITLKWGKKVRFVVMGNM

SEQ ID NO: 4160 - protein, 63 aa, Arabidopsis thaliana
IKTLKKSELQVLLRMLPKYYEHVGDHENTLITKFFGVHRITLKWGKKVRFVVMGNMFCTELKI

SEQ ID NO: 4161 - protein, 197 aa, Arabidopsis thaliana
MAREKIVVAGGTTKSWKLLLGLRIFAFMATLAAAIVMSLNKETKTLVVATIGTVPIKATLTAKFQHTPAFVFFVIANVMVSFHNLLMIVVQIFSRKLEYKGLRLLSIAILDMLNATLVSAAANAAVFVAELGKNGNKHAKWNKVCDRFTTYCDHGAGAIIAAFAGVILMLLVSAVSISRLLINSKNFSTTATTTSVV

SEQ ID NO: 4162 - protein, 141 aa, Arabidopsis thaliana
KSWKLLLGLRIFAFMATLAAAIVMSLNKETKTLVVATIGTVPIKATLTAKFQHTPAFVFFVIANVMVSFHNLLMIVVQIFSRKLEYKGLRLLSIAILDMLNATLVSAAANAAVFVAELGKNGNKHAKWNKVCDRFTTYCDH

SEQ ID NO: 4163 - protein, 154 aa, Arabidopsis thaliana
EKIVVAGGTTKSWKLLLGLRIFAFMATLAAAIVMSLNKETKTLVVATIGTVPIKATLTAKFQHTPAFVFFVIANVMVSFHNLLMIVVQIFSRKLEYKGLRLLSIAILDMLNATLVSAAANAAVFVAELGKNGNKHAKWNKVCDRFTTYCDHGAG

SEQ ID NO: 4164 - protein, 422 aa, Arabidopsis thaliana
MATLKCIDWQFSGSEAAKDAAAASLGSYTSALYALCDPHGKPILPPRNEILETSNTAEKAVVKAVLYGSGNAYAPSLGLAAAKSAVAEYLNQGLPKKLTADDVFMTLGCKQAIELAVDILAKPKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLTLHDLDGVFRNTKVLQAAQDFLQINNNPPTVIQAAIPDILEKTPQEFFDKRQSFLKDKVEFGYSKLKYIPSLTCYMKPEACTFLWTELDLSSFVDIEDDQDFCNKLAKEENLVVLPGIAFSQKNWLRHSIDMETPVLEDALERLKSFCDRHSNKKAPLKDVNGVK

SEQ ID NO: 4165 - protein, 894 aa, Arabidopsis thaliana
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQKCLKDDDPYVRKTAAICVAKLFDINAELVEDRGFLEALKDLISDNNPMVVANAVAALAEIQENSSSPIFEINSTTLTKLLTALNECTEWGQVFILDALSKYKAADPREAENIVERVTPRLQHANCAVVLSAVKMILQQMELITSTDVIRNLCKKMAPPLVTLLSAEPEIQYVALRNINLIVQKRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLENFPEEPAQVQLQLLTATVKLFLKKPTEGPQQMIQVVLNNATVETDNPDLRDRAYIYWRLLSTDPEAAKDVVLAEKPVISDDSNQLDPSLLDELLTNISTLSSVYHKPPEAFVTRLKTTVQKTEDEDFAEGSEAGYSSSNPVDSAASPPGNIPQPSGRQPAPAVPAPVPDLLGDLMGLDNAAIVPVDDPITQSGPPLPVVVPASSGQGLQISAQLSRKDGQVFYSMLFENNSQSVLDGFMIQFNKNTFGLAAAGSLQIPPLHPATSARTMLPMVLFQNMSAGPPSSLLQVAVKNNQQPVWYFTDKIILHALFGEDGRMERGTFLETWRSLPDSNEVLKEFPGITITSVESTIELLTAFNMFFIAKRKNGNQDVIYLSAKDPRDVPFLIELTAMVGQPGLKCAVKTPTPEIAPLFFEALELLFKA

SEQ ID NO: 4166 - protein, 350 aa, Arabidopsis thaliana
MGKGGALSDGVIKKILLSYTYVAIWIFLSFTVIVYNKYILDKKMYNWPFPITLTMIHMAFCSSLAVILIKVFKIVEPVSMSRDTYIRSVVPIGALYSLSLWLSNSAYIYLSVSFIQMLKALMPVAVYSIGVLLKKESFKSETMTNMLSISFGVAIAAYGEAKFDTWGVMLQLGAVAFEATRLVLIQILLTSKGINLNPITSLYYVAPCCLVFLFFPWIFVELPILRETSSFHFDFVIFGTNSVCAFALNLAVFLLVGKTSALTMNVAGVVKDWLLIAFSWSVIKDTVTPLNLFGYGLAFLGVAYYNHCKLQALKAKDAQKKVQQGDEEEAGKLLEERESEAAAKRNETED

SEQ ID NO: 4167 - protein, 128 aa, Arabidopsis thaliana
TYTSVILASVKQGNMDDAIRLKDEMLSDGISMNVVAATSLITGHCKNNDLVSALVLFDKMEKEGPSPNSVTFSVLIEWFRKNGEMEKALEFYKKMEVLGLTPSVFHVHTIIQGWLKGQKHEEALKLFD

SEQ ID NO: 4168 - protein, 31 aa, Arabidopsis thaliana
MEKALEFYKKMEVLGLTPSVFHVHTIIQGWL

SEQ ID NO: 4169 - protein, 329 aa, Arabidopsis thaliana
MAGKLMHALQYNSYGGGAAGLEHVQVPVPTPKSNEVCLKLEATSLNPVDWKIQKGMIRPFLPRKFPCIPATDVAGEVVEVGSGVKNFKAGDKVVAVLSHLGGGGLAEFAVATEKLTVKRPQEVGAAEAAALPVAGLTALQALTNPAGLKLDGTGKKANILVTAASGGVGHYAVQLAKLANAHVTATCGARNIEFVKSLGADEVLDYKTPEGAALKSPSGKKYDAVVHCANGIPFSVFEPNLSENGKVIDITPGPNAMWTYAVKKITMSKKQLVPLLLIPKAENLEFMVNLVKEGKVKTVIDSKHPLSKAEDAWAKSIDGHATGKIIVEP

SEQ ID NO: 4170 - protein, 415 aa, Arabidopsis thaliana
MEFVTETLGKRIHDPYVEETRCLMIPGPIIVGSGPSGLATAACLKSRDIPSLILERSTCIASLWQHKTYDRLRLHLPKDFCELPLMPFPSSYPTYPTKQQFVQYLESYAEHFDLKPVFNQTVEEAKFDRRCGLWRVRTTGGKKDETMEYVSRWLVVATGENAEEVMPEIDGIPDFGGPILHTSSYKSGEIFSEKKILVVGCGNSGMEVCLDLCNFNALPSLVVRDSVHVLPQEMLGISTFGISTSLLKWFPVHVVDRFLLRMSRLVLGDTDRLGLVRPKLGPLERKIKCGKTPVLDVGTLAKIRSGHIKVYPELKRVMHYSAEFVDGRVDNFDAIILATGYKSNVPMWLKGVNMFSEKDGFPHKPFPNGWKGESGLYAVGFTKLGLLGAAIDAKKIAEDIEVQRHFLPLARPQHC

SEQ ID NO: 4171 - protein, 178 aa, Arabidopsis thaliana
TTGGKKDETMEYVSRWLVVATGENAEEVMPEIDGIPDFGGPILHTSSYKSGEIFSEKKILVVGCGNSGMEVCLDLCNFNALPSLVVRDSVHVLPQEMLGISTFGISTSLLKWFPVHVVDRFLLRMSRLVLGDTDRLGLVRPKLGPLERKIKCGKTPVLDVGTLAKIRSGHIKVYPELK

SEQ ID NO: 4172 - protein, 114 aa, Arabidopsis thaliana
MLGISTFGISTSLLKWFPVHVVDRFLLRMSRLVLGDTDRLGLVRPKLGPLERKIKCGKTPVLDVGTLAKIRSGHIKVYPELKRVMHYSAEFVDGRVDNFDAIILATGYKSNVPM

SEQ ID NO: 4173 - protein, 152 aa, Arabidopsis thaliana
EVLGPCVCLAKGAAETLKLNMALILLPVCRNTITWLRNKTRLGVFVPFDDNLNFHKVIAVGIAIGVAIHSVSHLACDFPLLIAATPAEYMPLGKFFGEEQPKRYLHFVKSTEGITGLVMVFLMVIAFTLAMPWFRRGKLEKKLPGPLKKLAS

SEQ ID NO: 4174 - protein, 61 aa, Arabidopsis thaliana
VKSTEGITGLVMVFLMVIAFTLAMPWFRRGKLEKKLPGPLKKLASFNAFWYTHHLFVIVYI

SEQ ID NO: 4175 - protein, 281 aa, Arabidopsis thaliana
MVLTHNVLAVTFGVLGNIISFIVFLAPVPTFVRICKKKSIEGFESLPYVSALFSAMLWIYYALQKDGAGFLLITINAVGCFIETIYIILFITYANKKARISTLKVLGLLNFLGFAAIILVCELLTKGSNREKVLGGICVGFSVCVFAAPLSIMRVVIRTKSVEFMPFSLSLFLTISAITWLFYGLAIKDFYVALPNILGAFLGAVQMILYVIFKYYKTPLVVDETEKPKTVSDHSINMVKLSSTPASGDLTVQPQTNPDVSHPIKTHGGDLEDQMDKKMPN

SEQ ID NO: 4176 - protein, 485 aa, Solanum lycopersicum
MALLVEKTTSGREYKVKDMSQADFGRLEIELAEVEMPGLMASRAEFGPSQPVKGAKITCSLHMTIQTAFLIETLTALGAEVRWCSCNIFSTQDHAAAAIARDSAAVFAWKGETLQEYWWCTERALDWGPGGGPDLIVDDGGDATLLIHEGVKAEEEFAKNGTVPDPTSTDNVEFQLVLTIIKESLKTDPLRYTKMKERLVGVSEETTTGVKKLYQMPANGSLLFLPINVNDSVTKSKFDNLYGCRHSLPDGLMRATDVMIAGKVALVAGYGDVGKGCAAAMKQAGARVIVTEIDPICALQATMEGLQVLFLEDVVSEVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWNERSSGKYEKKVYVLPKHLDEKVAALHLGKFGAKLTKLTKDQADYIYVPVEGPYKPAHYRY

SEQ ID NO: 4177 - protein, 521 aa, Glycine max
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEAGPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 4178 - protein, 60 aa, Arabidopsis thaliana
IAALVLTWTVHYRGGLALSSDNKDHIFNVHPVMMVIGLILFNGEAMLAYKSVQGTKNLKK

SEQ ID NO: 4179 - protein, 56 aa, Arabidopsis thaliana
VHPVMMVIGLILFNGEAMLAYKSVQGTKNLKKLVHLTLQLTAFILSLIGVWAALKF

SEQ ID NO: 4180 - protein, 181 aa, Arabidopsis thaliana
MADQVKERTLEETSTWAVAVVCFVLLFISIVLEHSIHKIGTWFKKKHKQALFEALEKVKAELMLLGFISLLLTIGQTPISNICISQKVASTMHPCSAAEEAKKYGKKDAGKKDDGDGDKPGRRLLLELAESYIHRRSLATKGYDKCAEKGKVAFVSAYGIHQLHIFIFVLAVVHVVYCIVT

SEQ ID NO: 4181 - protein, 68 aa, Arabidopsis thaliana
MADQVKERTLEETSTWAVAVVCFVLLFISIVLEHSIHKIGTWFKKKHKQALFEALEKVKAELMLLGFI

SEQ ID NO: 4182 - protein, 1207 aa, Arabidopsis thaliana
MRGDSFSMSIENLPDSPMGSRKKKMQIRKVFDKMTEWVTPWRSNLESPREMMILRGDVEQDEFQYASSHCLSSYYSVFVVRLAIMVMLAILIGLLTVLTWHFTRIYTKQSLQTLAYGLRYELLQRPVLRMWSVLNTTSELTTAQVKLSEYVIKKYDKPTTQEELVEMYQAMKDVTWALFASAKALNAITINYRNGFVQAFHRDPASSSTFYIFSDLKNYSISGTGPEDVSGWNNKSIHGNMSAIWYQQQLDPVTGENLGKPLKIPPDDLINIAGISQVPDGEASWHVTVSKYMDSPLLSAALPVFDASNKSIVAVVGVTTALYSVGQLMRDLVEVHGGHIYLTSQEGYLLATSTDGPLLKNTSNGPQLMKATDSEEWVIKSGAQWLEKTYGSKRPHVVHAENVKLGDQRYYIDSFYLNLKRLPIVGVVIIPRKFIMGKVDERAFKTLIILISASVCIFFIGCVCILILTNGVSKEMKLRAELIRQLDARRRAEASSNYKSQFLANMSHELRTPMAAVIGLLDILISDDCLSNEQYATVTQIRKCSTALLRLLNNILDLSKVESGKLVLEEAEFDLGRELEGLVDMFSVQCINHNVETVLDLSDDMPALVRGDSARLVQIFANLISNSIKFTTTGHIILRGWCENINSLHDEMSVSVDRRKPWAPMKTKQVQHRNHLQKSCKNANKMVLWFEVDDTGCGIDPSKWDSVFESFEQADPSTTRTHGGTGLGLCIVRNLVNKMGGEIKVVQKNGLGTLMRLYLILSTPDTVDQNIQPDFSKYGLVVMLSMYGSTARMITSKWLRKHGIATVEASDWNELTQIIRDLLETGSRDNSFDSQHNISDPLRAELSNIVEIKNPVFVIVVDIGVLDLTTNIWKEQLNYLDRFSNKAKFAWLLKHDTSNTVKTELRRKGHVMMVNKPLYKAKMIQILEAVIKNRKRGLCNDLRNRGNGSDESHDCLEIDPTQFDTCSSDDSSETSGEKQVDKSVKPSTLHSPVLKNYLIDATTSNDDSTSASMTQKNPEEEDWKDRLYSGIALDGKNQKSLEGIRILLAEDTPVLQRVATIMLEKMGATVTAVWDGQQAVDSLNYKSINAQAPTEEHKSFEEETANKVTTRETSLRNSSPYDLILMDCQMPKMDGYEATKAIRRAEIGTELHIPIVALTAHAMSSDEAKCLEVGMDAYLTKPIDRKLMVSTILSLTKPSAFQTSLSA

SEQ ID NO: 4183 - protein, 200 aa, Arabidopsis thaliana
PDGEASWHVTVSKYMDSPLLSAALPVFDASNKSIVAVVGVTTALYSVGQLMRDLVEVHGGHIYLTSQEGYLLATSTDGPLLKNTSNGPQLMKATDSEEWVIKSGAQWLEKTYGSKRPHVVHAENVKLGDQRYYIDSFYLNLKRLPIVGVVIIPRKFIMGKVDERAFKTLIILISASVCIFFIGCVCILILTNGVSKEMKL

SEQ ID NO: 4184 - protein, 71 aa, Arabidopsis thaliana
FVIVVDIGVLDLTTNIWKEQLNYLDRFSNKAKFAWLLKHDTSNTVKTELRRKGHVMMVNKPLYKAKMIQIL

SEQ ID NO: 4185 - protein, 376 aa, Oryza sativa
MAMWRAAAGHLLGRALGSRAAHTSAGSKKIVGVFYKGGEYADKNPNFVGCVEGALGIREWLESKGHHYIVTDDKEGLNSELEKHIEDMHVLITTPFHPAYVSAERIKKAKNLELLLTAGIGSDHIDLPAAAAAGLTVAEVTGSNTVSVAEDELMRILILLRNFLPGYQQVVHGEWNVAGIAYRAYDLEGKTVGTVGAGRIGRLLLQRLKPFNCNLLYHDRLKIDPELEKEIGAKYEEDLDAMLPKCDVIVINTPLTEKTRGMFNKERIAKMKKGVIIVNNARGAIMDTQAVADACSSGQVAGYGGDVWFPQPAPKDHPWRYMPNHAMTPHISGTTIDAQLRYAAGVKDMLDRYFKGEDFPVQNYIVKEGQLASQYQ

SEQ ID NO: 4186 - protein, 631 aa, Arabidopsis thaliana
MEVHKVVAPPHKSTVAKLKTKLKETFFPDDPLRQFRGQPNRTKLIRAAQYIFPILQWCPEYSFSLLKSDVVSGLTIASLAIPQGISYAKLANLPPIVGLYSSFVPPLVYAVLGSSRDLAVGPVSIASLILGSMLRQQVSPVDDPVLFLQLAFSSTFFAGLFQASLGILRLGFIIDFLSKATLIGFMGGAAIIVSLQQLKGLLGITHFTKHMSVVPVLSSVFQHTNEWSWQTIVMGVCFLLFLLSTRHLSMKKPKLFWVSAGAPLLSVIVSTLLVFVFRAERHGISVIGKLPEGLNPPSWNMLQFHGSHLALVAKTGLVTGIVSLTEGIAVGRTFAALKNYHVDGNKEMIAIGLMNVVGSATSCYVTTGAFSRSAVNNNAGAKTAVSNIVMSVTVMVTLLFLMPLFEYTPNVVLGAIIVTAVIGLIDLPAACHIWKIDKFDFLVMLCAFFGVIFLSVQNGLAIAVGLSLFKILMQVTRPKMVIMGNIPGTDIYRDLHHYKEAQRIPGFLVLSIESPVNFANSNYLTERTSRWIEECEEEEAQEKHSSLQFLILEMSAVSGVDTNGVSFFKELKKTTAKKDIELVFVNPLSEVVEKLQRADEQKEFMRPEFLFLTVAEAVASLSLKGPSLSNV

SEQ ID NO: 4187 - protein, 76 aa, Arabidopsis thaliana
KATLIGFMGGAAIIVSLQQLKGLLGITHFTKHMSVVPVLSSVFQHTNEWSWQTIVMGVCFLLFLLSTRHLSMKKPK

SEQ ID NO: 4188 - protein, 130 aa, Arabidopsis thaliana
LSLFKILMQVTRPKMVIMGNIPGTDIYRDLHHYKEAQRIPGFLVLSIESPVNFANSNYLTERTSRWIEECEEEEAQEKHSSLQFLILEMSAVSGVDTNGVSFFKELKKTTAKKDIELVFVNPLSEVVEKL

SEQ ID NO: 4189 - protein, 105 aa, Arabidopsis thaliana
DSMLQTDDEATPLKKKLDEFGSFLAKVIAGICVLVWVVNIGHFSDPSHGGFFKGAIHYFKIAVALAVAAIPEGLPAVVTTCLALGTKKMARLNAIVRSLPSVETL

SEQ ID NO: 4190 - protein, 107 aa, Arabidopsis thaliana
DSMLQTDDEATPLKKKLDEFGSFLAKVIAGICVLVWVVNIGHFSDPSHGGFFKGAIHYFKIAVALAVAAIPEGLPAVVTTCLALGTKKMARLNAIVRSLPSVETLGC

SEQ ID NO: 4191 - protein, 105 aa, Arabidopsis thaliana
MLQTDDEATPLKKKLDEFGSFLAKVIAGICVLVWVVNIGHFSDPSHGGFFKGAIHYFKIAVALAVAAIPEGLPAVVTTCLALGTKKMARLNAIVRSLPSVETLGC

SEQ ID NO: 4192 - protein, 374 aa, Arabidopsis thaliana
MGNQTSKKSQETSAKSVHYTTELRSYAAACKADTELQSFDTCLQARTSHVISTLATGVEVRALSFDSLKEVTQCLLEMNQEVVKVILDCKKDIWKNQEMFELVEDYFENSLKTLDFCAALEKGLRRARDSHLLILVALQQFEDESLVQGGNGYKKTLEELKNFKDAESPFNEDFFKMFQSVYKQQMLMLEKLQHRKNKLDKKLKCIHTWRKLSSIIFVATFATVLICSVVAAAMAAPPVAAALAAATAVPLGSMGKWIDSLWKNYENALKGQKEVISSMQAGTFVAVKDLDNIRVLIERLEIEITGMVKSAEFAVEHNAVKIGIDDIKKKLEVFKKNVEELGTQADLCSRDIRRARTVILQRIIKHPNNASSST

SEQ ID NO: 4193 - protein, 88 aa, Arabidopsis thaliana
FQSVYKQQMLMLEKLQHRKNKLDKKLKCIHTWRKLSSIIFVATFATVLICSVVAAAMAAPPVAAALAAATAVPLGSMGKWIDSLWKNY

SEQ ID NO: 4194 - protein, 31 aa, Arabidopsis thaliana
LDKKLKCIHTWRKLSSIIFVATFATVLICSV

SEQ ID NO: 4195 - protein, 514 aa, Arabidopsis thaliana
MRWSIATAIASTAKGFLHLHHHFLKNSNPGIVLSPSLRFRFWVRAFSGTTIDYREVLRSGLHNIKFDDAFHLFVLMAYSYPLPSIVEFNKVLTAIAKMQMYDVVINLWKRIENAEGIEISPDLYTCNILVNCFCRCFQPSSALSYLGKMMKLGIEPDIVTASSLVNGFCLSNSIKDAVYVAGQMEKMGIKRDVVVDTILIDTLCKNRLVVPALEVLKRMKDRGISPNVVTYSSLITGLCKSGRLADAERRLHEMDSKKINPNVITFSALIDAYAKRGKLSKVDSVYKMMIQMSIDPNVFTYSSLIYGLCMHNRVDEAIKMLDLMISKGCTPNVVTYSTLANGFFKSSRVDDGIKLLDDMPQRGVAANTVSCNTLIKGYFQAGKIDLALGVFGYMTSNGLIPNIRSYNIVLAGLFANGEVEKALSRFEHMQKTRNDLDIITYTIMIHGMCKACMVKEAYDLFYKLKFKRVEPDFKAYTIMIAELNRAGMRTEADALNRFYQKHVRQNESAPAEVS

SEQ ID NO: 4196 - protein, 434 aa, Arabidopsis thaliana
MYVGFTSATGRLRSSHYILGWTFKLNGTASNIDISRLPKLPRDSRSTSVKKILAISLSLTSLAILVFLTISYMLFLKRKKLMEVLEDWEVQFGPHRFAYKDLYIATKGFRNSELLGKGGFGKVYKGTLSTSNMDIAVKKVSHDSRQGMREFVAEIATIGRLRHPNLVRLLGYCRRKGELYLVYDCMPKGSLDKFLYHQPEQSLDWSQRFKIIKDVASGLCYLHHQWVQVIIHRDIKPANVLLDDSMNGKLGDFGLAKLCEHGFDPQTSNVAGTFGYISPELSRTGKASTSSDVFAFGILMLEITCGRRPVLPRASSPSEMVLTDWVLDCWEDDILQVVDERVKQDDKYLEEQVALVLKLGLFCSHPVAAVRPSMSSVIQFLDGVAQLPNNLFDIVKARENVGAIEGFGEAAESLAEPCSVATLTFTEPFVSHGR

SEQ ID NO: 4197 - protein, 559 aa, Arabidopsis thaliana
MYLPEKSVLLELISRCSSLRVFKQIQTQLITRDLLRDDLIINKVVTFLGKSADFASYSSVILHSIRSVLSSFSYNTLLSSYAVCDKPRVTIFAYKTFVSNGFSPDMFTFPPVFKACGKFSGIREGKQIHGIVTKMGFYDDIYVQNSLVHFYGVCGESRNACKVFGEMPVRDVVSWTGIITGFTRTGLYKEALDTFSKMDVEPNLATYVCVLVSSGRVGCLSLGKGIHGLILKRASLISLETGNALIDMYVKCEQLSDAMRVFGELEKKDKVSWNSMISGLVHCERSKEAIDLFSLMQTSSGIKPDGHILTSVLSACASLGAVDHGRWVHEYILTAGIKWDTHIGTAIVDMYAKCGYIETALEIFNGIRSKNVFTWNALLGGLAIHGHGLESLRYFEEMVKLGFKPNLVTFLAALNACCHTGLVDEGRRYFHKMKSREYNLFPKLEHYGCMIDLLCRAGLLDEALELVKAMPVKPDVRICGAILSACKNRGTLMELPKEILDSFLDIEFEDSGVYVLLSNIFAANRRWDDVARIRRLMKVKGISKVPGSSYIEKFMTLDQ

SEQ ID NO: 4198 - protein, 951 aa, Arabidopsis thaliana
MASKKMTKSYFDVLGICCTSEVPLIENILNSMDGVKEFSVIVPSRTVIVVHDTLILSQFQIVKALNQAQLEANVRVTGETNFKNKWPSPFAVVSGILLLLSFFKYLYSPFRWLAVAAVVAGIYPILAKAVASLARFRIDINILVVVTVGATIGMQDYTEAAVVVFLFTIAEWLQSRASYKASAVMQSLMSLAPQKAVIAETGEEVEVDELKTNTVIAVKAGETIPIDGVVVDGNCEVDEKTLTGEAFPVPKLKDSTVWAGTINLNGYITVNTTALAEDCVVAKMAKLVEEAQNSKTETQRFIDKCSKYYTPAIILISICFVAIPFALKVHNLKHWVHLALVVLVSACPCGLILSTPVATFCALTKAATSGLLIKGADYLETLAKIKIVAFDKTGTITRGEFIVMDFQSLSEDISLQSLLYWVSSTESKSSHPMAAAVVDYARSVSVEPKPEAVEDYQNFPGEGIYGKIDGKEVYIGNKRIASRAGCLSVPDIDVDTKGGKTIGYVYVGETLAGVFNLSDACRSGVAQAMKELKSLGIKIAMLTGDNHAAAMHAQEQLGNAMDIVRAELLPEDKSEIIKQLKREEGPTAMVGDGLNDAPALATADIGISMGVSGSALATETGNIILMSNDIRRIPQAIKLAKRAKRKVVENVVISITMKGAILALAFAGHPLIWAAVLADVGTCLLVILNSMLLLSDKHKTGNKCYRESSSSSVLIAEKLEGDAAGDMEAGLLPKISDKHCKPGCCGTKTQEKAMKPAKASSDHSHSGCCETKQKDNVTVVKKSCCAEPVDLGHGHDSGCCGDKSQQPHQHEVQVQQSCHNKPSGLDSGCCGGKSQQPHQHELQQSCHDKPSGLDIGTGPKHEGSSTLVNLEGDAKEELKVLVNGFCSSPADLAITSLKVKSDSHCKSNCSSRERCHHGSNCCRSYAKESCSHDHHHTRAHGVGTLKEIVIE

SEQ ID NO: 4199 - protein, 104 aa, Arabidopsis thaliana
EDCVVAKMAKLVEEAQNSKTETQRFIDKCSKYYTPAIILISICFVAIPFALKVHNLKHWVHLALVVLVSACPCGLILSTPVATFCALTKAATSGLLIKGADYLE

SEQ ID NO: 4200 - protein, 74 aa, Arabidopsis thaliana
CFVAIPFALKVHNLKHWVHLALVVLVSACPCGLILSTPVATFCALTKAATSGLLIKGADYLETLAKIKIVAFDK

SEQ ID NO: 4201 - protein, 82 aa, Arabidopsis thaliana
TYDMIHAGGLFSLYEHRCDLTLILLEMDRILRPEGTVVLRDNVETLNKVEKIVKGMKWKSQIVDHEKGPFNPEKILVAVKTY

SEQ ID NO: 4202 - protein, 87 aa, Arabidopsis thaliana
YDMIHAGGLFSLYEHRCDLTLILLEMDRILRPEGTVVLRDNVETLNKVEKIVKGMKWKSQIVDHEKGPFNPEKILVAVKTYWTGQPS

SEQ ID NO: 4203 - protein, 985 aa, Arabidopsis thaliana
MECCAPVIGEILRLMYESTFSRVANAIKFKSNVKALNESLERLTELKGNMSEDHETLLTKDKPLRLKLMRWQREAEEVISKARLKLEERVSCGMSLRPRMSRKLVKILDEVKMLEKDGIEFVDMLSVESTPERVEHVPGVSVVHQTMASNMLAKIRDGLTSEKAQKIGVWGMGGVGKTTLVRTLNNKLREEGATQPFGLVIFVIVSKEFDPREVQKQIAERLDIDTQMEESEEKLARRIYVGLMKERKFLLILDDVWKPIDLDLLGIPRTEENKGSKVILTSRFLEVCRSMKTDLDVRVDCLLEEDAWELFCKNAGDVVRSDHVRKIAKAVSQECGGLPLAIITVGTAMRGKKNVKLWNHVLSKLSKSVPWIKSIEEKIFQPLKLSYDFLEDKAKFCFLLCALFPEDYSIEVTEVVRYWMAEGFMEELGSQEDSMNEGITTVESLKDYCLLEDGDRRDTVKMHDVVRDFAIWIMSSSQDDSHSLVMSGTGLQDIRQDKLAPSLRRVSLMNNKLESLPDLVEEFCVKTSVLLLQGNFLLKEVPIGFLQAFPTLRILNLSGTRIKSFPSCSLLRLFSLHSLFLRDCFKLVKLPSLETLAKLELLDLCGTHILEFPRGLEELKRFRHLDLSRTLHLESIPARVVSRLSSLETLDMTSSHYRWSVQGETQKGQATVEEIGCLQRLQVLSIRLHSSPFLLNKRNTWIKRLKKFQLVVGSRYILRTRHDKRRLTISHLNVSQVSIGWLLAYTTSLALNHCQGIEAMMKKLVSDNKGFKNLKSLTIENVIINTNSWVEMVSTNTSKQSSDILDLLPNLEELHLRRVDLETFSELQTHLGLKLETLKIIEITMCRKLRTLLDKRNFLTIPNLEEIEISYCDSLQNLHEALLYHQPFVPNLRVLKLRNLPNLVSICNWGEVWECLEQVEVIHCNQLNCLPISSTCGRIKKIKGELSWWERLEWDDPSALTTVQPFFNPVREVPLLIADATTQML

SEQ ID NO: 4204 - protein, 795 aa, Arabidopsis thaliana
MARPRLLVVSMSLPVTAKRTGEESWSFTMSPGGLVSALLGLKEFETKWIGWPGVDVHDAIGKKTLSITLAEKGCIPVFLEEVCDQYYNGYCNNILWPIFHYLGTPPEYRNDATITYQSQYEAYKKANQIFFDVVKEHYEEGDVVWCHDYHVMLLPQYLKEYNSKMKVGWFLHTPFPSSEMYKTLPSRSDLLRSVLTADLVGFHTYDFARHFLNACMCILGVEATSEGIVDQGKVTRVAVFPIGIEPERFINTSELSEVVQYMKKFKNDFGGRKLILGVDRLDTIKGIPQKYQAFEKFLEENAEWRGKVMLLQIAVPTRNGIGEYQKIKDQCHYHVGRINGRFGSISSVPIIHLDCSIDFNQLCALYAITDVLLVTSLRDGMNLVSSEFIACQKAEKGVLILSEFAGAGQSLGAGAILVNPWNIKEVSSAIGEALNMSHEEKERKHKINFQYVKTHSTQQWADDFMKLTLTNILCSKLIEITTSAELGAGLAATLELPEHDVIQQYSKSNNRLLILGFYGTLTQPMKNQERRGDGMNLELHPQLKERLKELCSDPKTTVVVLSRSEKCILDKNFGEYNMWLAAENGMFLRHTSGEWVTRIPEHMNLEWIDGVKHVFKYFTERTPGSYLETSEASLVWNYENADAEFGRAQARDMLQHLWAGPISNASVDVVRGGQSVEVHAVGVTKGSAMERILGEIVHNKSMATPIDYVLCIGCFLGKDEDVYTFFEPELTKKAKSLSSSGSDSPKKVSSTIVDLKGENYFSVAIGQTHTKARYFLDSSDDVVKLIGKLCTHNNA

SEQ ID NO: 4205 - protein, 76 aa, Arabidopsis thaliana
ATLSATIVHVLVFNGSDLWKQTRGAFQKNKKMDIHTRIMKKNYREVPLWWFLVILLLNIALIMFISVHYNATVQLP

SEQ ID NO: 4206 - protein, 70 aa, Arabidopsis thaliana
TIVHVLVFNGSDLWKQTRGAFQKNKKMDIHTRIMKKNYREVPLWWFLVILLLNIALIMFISVHYNATVQL

SEQ ID NO: 4207 - protein, 397 aa, Arabidopsis thaliana
MTTSQFKKSKLIENNSQSLEILKEKNFNDVPLDVAIEIFMRLPVKSVARFLLLSKFWAEIIRSRHFITSFQVRSSLQPRLLVVFIDLNKQWNCEDWYFFSLSSSTTSYLSRVTCPFPDYVHYSHYVNGLISHGYGLEKFITNPSTGKSTVLGRVQTNSKVAQCFLGYDPVNDEYKLLVLCMKEKMQRHDGRTRILQLSSQHQVFPLGVKKKPWRMIDYTTPHGPVLNSVCIDGVLYYVAFTGEDLSQLSLMRFDLGSEKLDLFTSLPADFPAAFLHGFTLMRYKGKVALATKTLFIGIEVWVLDQQAEIHGWLKKSFSIKGVRRWLFCDLFITGTTHTGEFILAPRFYSNSFYVIYYNPDTKSLRKTKVEVHGGYDFKHRETKAMVFPDYVETVRLL

SEQ ID NO: 4208 - protein, 332 aa, Sus scrofa
MSTVKEQLIENLIEEDEVSQSKITIVGTGAVGMACAICILLKDLADELALVDVAVDKLKGETMDLQHGSLFFNTSKIVSGKDYSVSANSKIVIVTAGARQQEGESRLALVQRNVNIMKSIIPTIVQHSPDCKMLIVSNPVDILTYVAWKLSGLPATRVIGSGCNLDSARFRYLIGKKLGVHPTSCHGWIIGEHGDSSVPLWSGVNVAGVALKTLDPKLGTDSDKDQWKNIHKQVIGSAYEIIKLKGYTSWAIGLSVTDLVGSILKNLRRVHPVSTMVKGLYGIKEEIFLSIPCVLGRNGVSDIVKVNLNAEEEALFKKSANTLWNVQKDLTF

SEQ ID NO: 4209 - protein, 412 aa, Sus scrofa
MPLFLYMVLLVLGIHCVQPNISEGKVTSCLSPQQNATLHKMSSINADFAFNLYRRFAVETPDQNIFFSPVSISAALAMLSFGACSSTQTQILESLGYNLTEMPMAEIQQGFQHLICSLNFPKKELELQMGNALFIEKQLKPLAKFLDDVKNLYETEVFSTDFSNVSAAQQELNSHVERQTKGKIVGLIPDLKPNTIMVLVNYICFKAQWANPFDPSKTEEGSSFLVDKTTTVQVPMMHQMEQYYHLVDTELNCTVLQMDYSKNALALFVLPNEGQMEWVEGAMSSKILKKWNRLLQKGWIDLFVPKFSMSATYDLGDILLKMGIQDAFADNADFSGLTKDNGLKLSNAAHKAVLNIGEKGTEAIPEVTFLNQPKITLLHPIIQFDRSFLLLILEKSTRSILFLGKVVDPTEA

SEQ ID NO: 4210 - protein, 411 aa, Bos taurus
MPLFSLVLLILGLHCAPPNSCEGKITSCLSPQQNATLYKMSSINADFAFNLYRRFTVEIPDQNIFFSPVSIPAGLAMLSLGACSSTQTQILEGLGFNLTDTPVAEIQQGFQHLICSLNFPKKELELQMGNALFIGKQLKPLEKFLDDVKNLYETEVFSTDFSNVSAAQQEINSHVEKQTKGKIVGLIQDLKPNTITVLVNYLCFKAQWANPFDPSKTEEGSSFLVDKTTTVQVPMMHQMEQYYHLVDTELNCTVLQMDYSKNALALFVLPKEGQMEWVEGAMSSKTLKKWNRLLRKGWVDLFVPKFSISATYDLGDILLKMGIQDAFADNADFSGLTKDNGLKVSNVAHKAMFYIGEKGTEAVPEVRFLNQPETTLLHPIIQFDRSFLLLILEKNTRSILFLGKVVDPTEA

SEQ ID NO: 4211 - protein, 88 aa, Oryctolagus cuniculus
AFLAVSLVKVFAPYACGSGIPEIKTILSGFIIRGYLGKWTLVIKTITLVLAVSSGLSLGKEGPLVHVACCCGNILCHRFNKYRKNEAK

SEQ ID NO: 4212 - protein, 74 aa, Oryctolagus cuniculus
VKVFAPYACGSGIPEIKTILSGFIIRGYLGKWTLVIKTITLVLAVSSGLSLGKEGPLVHVACCCGNILCHRFNK

SEQ ID NO: 4213 - protein, 85 aa, Oryctolagus cuniculus; identical to SEQ ID NO: 2735

SEQ ID NO: 4214 - protein, 73 aa, Oryctolagus cuniculus; identical to SEQ ID NO: 252

SEQ ID NO: 4215 - protein, 1033 aa, Oryctolagus cuniculus
MRQRKLEIYSVELHAATDIKKKEGRDGKKDNDLELKRNQQKEELKKELDLDDHKLSNKELETKYGTDIIRGLSSTRAAELLAQNGPNALTPPKQTPEIIKFLKQMVGGFSILLWVGAVLCWIAFGIQYVSNPSASLDRVYLGTVLAVVVILTGIFAYYQEAKSTNIMASFCKMIPQQAVVIRDSEKKVIPAEQLVVGDIVEIKGGDQIPADIRLLSAQGCKVDNSSLTGESEPQSRSSGFTHENPLETKNITFYSTTCLEGTATGMVINTGDRTIIGRIASLASGVGNEKTPIAIEIEHFVHIVAGVAVSVGILFFIIAVCMKYHVLDAIIFLIAIIVANVPEGLLATVTVALSLTAKRVAKKNCLVKNLEAVETLGSTSIICSDKTGTLTQNRMTVAHLWFDNQIFVADTSEDNLNQGFDQSSGTWTSLSKIIALCNRAEFKPGEESVPIMKRVVVGDASETALLKFSEVILGDVMEIRKRNHKVVEIPFNSTNKFQLSIHQTEDPNDKRFLLVMKGAPERILEKCSTIMINGKEQPLDKSMAQAFHTAYMELGGLGERVLGFCHFYLPADEFPETYSFDSESMNFPTSNLCFVGLLSMIDPPRSTVPDAVTKCRSAGIKVIMVTGDHPITAKAIAKSVGIISANSETVEDIAKRCNIAVEQVNKRDAKAAVVTGMELKDMSPEQLDELLANYPEIVFARTSPQQKLIIVEGCQRQDAVVAVTGDGVNDSPALKKADIGVAMGITGSDAAKNAADMILLDDNFSSIVTGVEEGRLIFDNLKKTIAYTLTKNIAELCPFLIYIILGLPLPIGTITLLFIDLGTDIIPSIALAYEKAESDIMNRKPRHKKKDRLVNQQLAVYSYLHIGLMQALGAFLVYFTVYAQQGFRPTSLFHLRIAWDSDHLNDLEDNYGQEWTSYQRQYLEWTGYTAFFVGIMVQQIADLIIRKTRKNSIFKQGLFRNKVIWVGIASQIIVALLLSYGLGSITALNFTMLKAQYWFVAVPHAILIWVYDEMRKLFIRLYPGSWWDKNMYY

SEQ ID NO: 4216 - protein, 78 aa, Oryctolagus cuniculus
VECHPYFTQPKLLKFCQQHDIIIVAYSPLGTCRNPMWVNTSLPPLLKDTLLNSLGKKYKKTAAQIVLRFNVQRGVVVI

SEQ ID NO: 4217 - protein, 200 aa, Oryctolagus cuniculus
IAEGKVRREDIFYCGKLWATNHDPVMVRPTLERTLKVLKLDYIDLYIIEIPMAFKPGDVVYPRDENGKWLYHKTNLCATWEALEACKDAGLVKSLGVSNFNRQQLELLLNKPGLKHKPVCNQVECHPYFTQPKLLKFCQQHDIIIVAYSPLGTCRNPMWVNTSLPPLLKDTLLNSLGKKYKKTAAQIVLRFNVQRGVVVI

SEQ ID NO: 4218 - protein, 608 aa, Caenorhabditis elegans
MSDVLLSKLSTELADLDGEIGQIDQQISQLRRKKSELTQKRQAIERKIELKTNEDSDVVTDRWDRDGFPWSDEATKILKEQFHLEKFRPLQRAAINAVMSKEDAVVILSTGGGKSLCYQLPALLANGLALVVSPLISLVEDQILQLRSLGIDSSSLNANTSKEEAKRVEDAITNKDSKFRLLYVTPEKLAKSKKMMNKLEKSLSVGFLKLIAIDEVHCCSQWGHDFRTDYSFLNVLKRQFKGVPILGLTATATSNVLDDVKDMLGIQAALTFRAGFNRSNLKYKVVQKPGSEDECTEEIAKTIKRDFAGQTGIIYCLSRNDCEKVAKALKSHGIKAKHYHAYMEPVDRSGAHQGWISGKIQVIVATVAFGMGIDKPNVRFVIHHSLPKSIENYYQESGRAGRDGQPATCILYYRLADIFKQSSMVQQERTGIQNLYNMVRYAADSSTCRRVKLAEHFEEAWEPSWCQKQCDTCENGNGFVGTSSKESTDVSEAAKTTVRIIEEHLNSAKDGSGRITGNKLVELLTKKLKGSRNREFCEKLIVNLLLEGYLQEDFHYTVYSVISYVVIGSKWRVYNGKDAIKMRHVEESKSRKRKASSSVEEEDVMVLD

SEQ ID NO: 4219 - protein, 152 aa, Heliothis virescens
LAPCMKAPMYASMPHFLDSDPELLTKVKGLNPDVTQHGIEIDYEPITGTPMVAKQRIQFNIQLLKTDKLDLFKDLSGDIVPLFWIDEGLALNKTFVNMLKHQLFIPKRVVGVLRWWVVSFGSLGAVIGIVFHFRDHIMRLAVSGDTKVSKVT

SEQ ID NO: 4220 - protein, 171 aa, Heliothis virescens
LAPCMKAPMYASMPHFLDSDPELLTKVKGLNPDVTQHGIEIDYEPITGTPMVAKQRIQFNIQLLKTDKLDLFKDLSGDIVPLFWIDEGLALNKTFVNMLKHQLFIPKRVVGVLRWWVVSFGSLGAVIGIVFHFRDHIMRLAVSGDTKVSKVTPEEPEQKDISVIGQAQEPA

SEQ ID NO: 4221 - protein, 109 aa, Caenorhabditis elegans
SLVRILKPHQAHGIQFMYDCACESLDRLDTEGSGGILAHCMGLGKTLQVITFLHTVLMHEKIGEKCKRVLVVVPKNVIINWFKEFQKWLVDNDEELDTIDVNELDSYKT

SEQ ID NO: 4222 - protein, 74 aa, Caenorhabditis elegans
FMYDCACESLDRLDTEGSGGILAHCMGLGKTLQVITFLHTVLMHEKIGEKCKRVLVVVPKNVIINWFKEFQKWL

SEQ ID NO: 4223 - protein, 126 aa, Plasmodium falciparum
KKVLIEGANAAMLDIDFGTYPYVTSSCTTVGGVFSGLGIHHKKLNLVVGVVKSYLTRVGCGPFLTELNNDVGQYLREKGHEYGTTTKRPRRCGWLDIPMLLYVKCINSIDMINLTKLDVLSGLEEI

SEQ ID NO: 4224 - protein, 95 aa, Plasmodium falciparum
IHHKKLNLVVGVVKSYLTRVGCGPFLTELNNDVGQYLREKGHEYGTTTKRPRRCGWLDIPMLLYVKCINSIDMINLTKLDVLSGLEEILLCVNFK

SEQ ID NO: 4225 - protein, 279 aa, Schizosaccharomyces pombe
MGFIKSTLLATVTVFVGLCGINRFFTLPKCIRYHFRYFACHTFLAISSAYGVIASVVARLCGYPVMGQYLTAKAYYGLASTILDFRFKIENEEILRKHKSAVLVVNHQSELDILAIGRTFGPNYSVIAKKSLRYVPILGWFMILSDVVFIDRSRRSDAIQLFAKAARRMRKENISIWVFAEGTRSYSLKPCLLPLKKGAFHLAVQAQVPIIPIAIQTYGHLFHPPTKVFNKGEALIKVLDPIPTEGKTAEDVNDLLHETETAMNNALVEIDDYGKVKKQ

SEQ ID NO: 4226 - protein, 415 aa, Schizosaccharomyces pombe
MASNVDKFSSRFYLNVNKEELKKEYVGKTIQQVPTPGFVIDEAIFEKNCNRMLDRASDIGVTFRAHVKTHKTIEGTLLQLGDGRTKAVVVSTLMEGFSLIPLILEGKIDDLLYGLPVAKSRLPELYELSKIVPHLRLMIDNPKQLDILREFTSTLPDDAKPWSIFVKIDMGTHRAGVTNDSQVVKDLISTILSDKSLFDLFGFYCHAGHSYASRSIDAASEFLCAEIDAANTAAKFATSIDPSLKLTLSVGATPTAHSVSPKVKELLPTLSGKLEVHAGNYPMNDVQQMITKCISQADVADYVFAEVISNYPGRNGEPGEVLVNAGVIAMSRETSPEGDFGIVITPGFESFYVDRLSQEHGILKSKDPKATLPDASQVLCIIPNHSCITAAAFPWYYITKGSDVITDIWVPWKGW

SEQ ID NO: 4227 - protein, 200 aa, Schizosaccharomyces pombe
MTLPEKLLKITPKILVIMGSVRSKRLCPTIATWVGEMGKRETNFDYEKVDLTDWPLSMSDEPGLPIMGIDVYTQEHTKAWGSKIAGADGFVFVTPQYNGGYPAILKNALDHLYHEWNGKPLLIVSYGGHGGGDCASQLKHVAGFLKMRVAPTMPALTLPRDKIVQGVVDPAVEFTKHLGELKKAFGEFSQLFESNPERKP

SEQ ID NO: 4228 - protein, 606 aa, Schizosaccharomyces pombe
MKVLGLISGGKDSCFNLMHCVSLGHEVVALANLHPEDGKDEIDSFMYQSVGHDVIPLYAECFDLPLYREKIGGQSINQNLDYQFTEKDETEDLYRLIKRVLTNHPDLEAVSTGAILSTYQRTRVENVCKRLGLKSLSFLWQKDQEKLLNDMVVSGLNAILIKVAAIGLTRKDLGKSLAEMQDKLLTLNKKFELHPCGEGGEYETLVLDCPLFKKRIVLTDKEVVEHSSGEVCYLKVKACVKDKPEWQPISLKSELVPNEELLGEEYSHIYHTISKKYELIDDQEETPTSLIPIPLRESAFQQKKGSFLVLGNVVATKGSYNTFQGEAESAINNLNELLGTYGYSNKNVYFVTVILSSMSKFAEFNSVYNKYFDFTNPPSRSCVAAPLASEYRIVMSCIVGDVTEKRALHVQGQSYWAPANIGPYSQSICANGVVFISGQIGLIPSVMELKLHDKIFEMVLALQHANRVAKAMRVGSLIACLAYVCDSRDADCVVKIWSEYTKNTGESSPVLVALVDALPRNASVEWQLLYNDSSCDVPLLSSLVTNQTLFGSDTAWDVALLNQNGLRMESSFIHHEHPSAYAIVLNNAFPNSQLLHVRYTARDQNV

SEQ ID NO: 4229 - protein, 58 aa, Schizosaccharomyces pombe
KVMSQMIPHLLLLQLIAGNFEGFWYGDRQTAKLIVHFMKFVLKKITSMEVNLNVLTRE

SEQ ID NO: 4230 - protein, 47 aa, Schizosaccharomyces pombe
WYGDRQTAKLIVHFMKFVLKKITSMEVNLNVLTRELHFKFVSFGLRI

SEQ ID NO: 4231 - protein, 1274 aa, Schizosaccharomyces pombe
MKFRLNANFNFSFRRYCFVQCRNKYHSHVRYLSSAKKSGILRNSYNQRTERYFTNIMIPSDYSNKFYPVDGVVPKHETQAYEFLKKFPEYDGRGVTVGILDTGVDPGAPGLSVTTTGLPKFKNIVDCTGAGDVDTSVEVAAADSNDYLTITGRSGRTLKLSKEWKNPSKKWKVGCKLAYEFFPKDLRKRLQKLETEDMNKSNRKLLQDATDEYAKFKDKFPEAPLDKDNLQTQKELEARIECLKQLAEKFDNPGPLYDVVVFHDGEHWRVVIDSDQTGDIYLHKPLADFNVAQEWSTFGSLDLLSYGVHVYDNGNITSIVAVSGTHGTHVAGIIGANHPETPELNGAAPGCQLVSLMIGDGRLDSLETSHAFSRACSEIIKNEVDIINISFGEDAGIPNKGRVIELLRDELAGKRNVVIVSSAGNNGPAYTTVGAPGGTTFDVISVGAYVTSGMMQAQYNLLSTVHDTPYTWCSRGPTLDGDTGVSIYAPGGAITSVPPYSLQNSQLMNGTSMSSPSACGGISLILSALKAQKKPYTAAAIKKAVMYTSKDLRDDFNTGMLQVDNAYEYLAQSDFQYTGARSFTINGNIGNSKRGVYLRNPTEVCSPSRHMFNVAPKFEDGEEYEKSHFEVQLSLATTQPWIQAPEYVMMAGTGRGIPVRVDPTALAPGHHFGKVLAYDASNESRRCVFEIPVTVMKPSSISNTCFSLRDVSFEPTLIKRHFLVPPKGATYVEIRVKATSELESTNMLWISVNQTIPQTKLNEASTELIMPVTQNEVTTKLVSIDDSYTLELCMAQWWSSLEPMVLDIDVNFHGIKVVNGKEINLISSQGLKRVDCASIRRENFKPDITLKDYVDSFKPTNTVIKPLGDRDIMPDGQQLFELMATYSVEISEKTELKADFAVPHNMYDNGFNGLFFMVFDSQKQRVHYGDMYTSSHTLEKGEYLYKFQLLSVDPSTLERFRNVTLRLTKKLKKPITLPLYADHIDFCDNKTYERENIDAGVVESFVVGTNIEGEQYASELKENSLLTGELKFGDCEKGTVPVTLVLPPKISTKEDTKLGEKCANIVQLQVDLLSKLADQEKEKHLKYLQSSYKNSLEVQLAKLDIVKETNERLSTADSILSLIDTEALSRYYSCQQKVEDTIPRDVVLEKKMALQRDAFIRALVVKCETFSTQGHKDKDNYFQNYQLLLNWLENSDPRVWQIKKDYYKSQNQYGLALKALLELLKENGNSGKMDVAKLLSEEKELLVNLGWNYWHDIVFVETVKRVPPYSYALF

SEQ ID NO: 4232 - protein, 451 aa, Schizosaccharomyces pombe
MSLEENVKEAKNAFNILQTLSVEDRDDALDKIVEELRIKKSEVLAANAEDMKAAKLLAESGKLSSSMVKRLDLSSSDKYDSMVQGVLDVKSLPDPLGRVTYARSLDDGLDLYKVSCPVGLLLVIFEARPEVIINITSLAIKSGNAVVLKGGTESAKSFAALSNVVRSALGKSKVPQAAVQLVQSREEVSQLLKLDEYIDLVIPRGSTNLVRHIKDNTKIPVLGHAAGLCSMYVHEDADMELASKLVLDGKTDYPAACNAIETLLINEAVLSSHLPKIAETLTEAKVTLKCDPASLKVLKDMPKVSALVEPSVDQDYNTEFSDLILAIKTVPSLQSAMQHINTHGSKHTDCIITSSEAAANRFMAGIDASGVYWNASTRFADGFRYGYGTEVGISTNKIHARGPMGLDGLTIYKYQLRGNGQVASSYGVGPGKRAFKHTPINIDNISQVSKK

SEQ ID NO: 4233 - protein, 100 aa, Schizosaccharomyces pombe
MTAKMAEPLYFRIWSSLNIICLMVTFLNVQLSKTPIVLMPLFIALLKNNRKRETKKQTISVLVQKREEKTKLVLDDANNHNHAFLYHCQYLGQKKHVVIQ

SEQ ID NO: 4234 - protein, 417 aa, Schizosaccharomyces pombe
MPIQLGLQRMLQLLKHLGNPQESFCAVQIAGTNGKGSICSYIYTSLLQAAIKTGRYTSPHFLEPRDTISINGQIASEEIFNTCWKQVIEVDRRFRTKATEFELLTATAFQCFHHSGVRVAVIETGMGGRLDATNVFEEPVLSIISRICLDHQAFLGNTLEAIAKEKAGIFKKNVPCVVDGLNEVNVLNQLKLSAEETRAHPFYLAKGKSGENKNEWIINTPNWGTNTFSTPLKGDYQGQNLACAVTALDILSSSFSIMLPHVQNGVKNTSWPGRLDIRSVPSLGDILFDGAHNKEAAIELAKFVNSQRREHNKSVSWVVAFTNTKDVTGIMKILLRKGDTVIATNFSSVSGMPWIKSMEPEVIKNSISSESSVECYTADNLTISEILRLAKEKNSSVIVCGSLYLLGDMYRYLKLDV

SEQ ID NO: 4235 - protein, 187 aa, Schizosaccharomyces pombe
MLVLVIGDFHIPDRAPKLSEKFRQLLIPGKISQIICLGNLTSTSVYEYLKHVCSDLKLVKGAFDISSKAPIAGKITLGSFKIGYTNGHLVVPQDSPEALSILAREMDADILLFGGTHKFAAYELDGCFFVNPGSATGAPNVSAVEDDEKIVPSFVLMDVQGAVLILYVYRIFDGEVRVEKMQYRKPE

SEQ ID NO: 4236 - protein, 274 aa, Schizosaccharomyces pombe
MDSAEKKLDLSPIELAKRLACHMAVDENYPENPKVIGIGSGSTVVYVVERLLTKPGVDSVVFIPTGFQSKQLIVNNGLRLGDPDCYPNVDVSFDGADEVDDNLQCIKGGGACLFQEKLIAFLAKRLVIVADSRKNSHVLGEYWKKGVPIEVMPMAYASILPQLVELGAIEPKLRMGAPGKAGPVVTDNGNFIIDAHFGLIKNPKELFAKIKLLVGVVEVGLFCDMISAVYFGSKDGSVTVKKASGEKHIIPAPVTAAANEVDAKVAETNAKPLN

SEQ ID NO: 4237 - protein, 133 aa, Schizosaccharomyces pombe
KSLFDDRMVYVNHVYGYMTFSKEKTYLLASGDIRGGILADEMGMGKTLEVLGLVLHHQLPISLTDTCTFDQVVGKNVKYSKATLIITPSTILDQWLSEIDLHVPSLKVFHYQGIRKSNGLKSAKIFLDCDIVV

SEQ ID NO: 4238 - protein, 123 aa, Schizosaccharomyces pombe
VNHVYGYMTFSKEKTYLLASGDIRGGILADEMGMGKTLEVLGLVLHHQLPISLTDTCTFDQVVGKNVKYSKATLIITPSTILDQWLSEIDLHVPSLKVFHYQGIRKSNGLKSAKIFLDCDIVV

SEQ ID NO: 4239 - protein, 1018 aa, Schizosaccharomyces pombe
MSSNLVALYLFSIDRSQDEANDVVDRIVEEIVTDRMGIVDLVTSIGEYLTDNNISVRAKAVLLLSQTLGELPKDRLPAKHVSVLLQFYLSRLDDEVTMKENALGIGALLNMQNFPAQKIVDVCKALFSSTDMPKYAQATRLNILKVFETIIDNYLFFISSQTRDAFFSGICSTFAGEKDPRNLMLVFSMLKKILSTFPIDGFEQQFFDITYCYFPITFRAPPDATNLAITSDDLKIALRETLVANDAFSKLLLPALFERLKASTVRIKIDALNIYIEACKTWRVGAYLWSAKDFWESIKQEILNSTDAELQNLALGALNTLASKFYKEEGFSSSFTEFVDMILIQLSQRLLEDVNVKSCGSCAAVFASLASISVETFNYCSCNFLPSVLDLPMVNEPLEKQKGMLVFLEYVYKCLVLLYGKWRSKNQADIDNPLLVYKDKQLSFVSGSLMGTAKDETEIRMLALKVIFLMASIKNFLTESELTMVLQFLDDIAFDFSDPIKKKATECLKDLGLLKPDFLLLTSFPFAFSKLTDDVTAKSSSEETFKQYLSVLVSISEERSLFKALVIRLVEMLKDQFKSKEMSVDLVESIVQSLSVAFKERNDRNEQEIPFFFEELLKQLFTLCFANCESMNVRCLIYVSQTINEIVRVNHFEFQEKFVGQLWKLYMENSNSDLIETEGCEKAAERFTLAASLSDQKFLNLVVLLQGGLNGLSKKLHFIEKLNIELLNLLINVVFVTESPGVKISALRLISSLINKCEKDEDISSFISSKGVTSLWDKVYTGTPKESEAALDVLAWVDKALVSRKHSEGIPLAFKLLDTLNLQNVGDSSVKALSIIIKDDPALSKENSYVEKLLYKQRFYASVSPKILEHISTATGGEKSLYLMLLSNVIGNVPKEIVIPDMPSILPLLLQCLSLSDISVKLSTLNVIHTSVKELTSLLTEYLDTLIPSLLAIPKDMNNPTVVRLLALKCLGSLPEFTPTTNLQLFRDKVIRGLIPCLDDPKRVVRTEASRTRHKWYI

SEQ ID NO: 4240 - protein, 275 aa, Sulfolobus solfataricus
MSSTPSNQNIIPIIKKESIVSLFEKGIRQDGRKLTDYRPLSITLDYAKKADGSALVKLGTTMVLAGTKLEIDKPYEDTPNQGNLIVNVELLPLAYETFEPGPPDENAIELARVVDRSLRDSKALDLTKLVIEPGKSVWTVWLDVYVLDYGGNVLDACTLASVAALYNTKVYKVEQHSNGISVNKNEVVGKLPLNYPVVTISVAKVDKYLVVDPDLDEESIMDAKISFSYTPDLKIVGIQKSGKGSMSLQDIDQAENTARSTAVKLLEELKKHLGI

SEQ ID NO: 4241 - protein, 556 aa, Drosophila melanogaster
MAVEVVQETLQQAASSSSTTVLGFSPMLTTLVGTLVAMALYEYWRRNSREYRMVANIPSPPELPILGQAHVAAGLSNAEILAVGLGYLNKYGETMKAWLGNVLLVFLTNPSDIELILSGHQHLTKAEEYRYFKPWFGDGLLISNGHHWRHHRKMIAPTFHQSILKSFVPTFVDHSKAVVARMGLEAGKSFDVHDYMSQTTVDILLSTAMGVKKLPEGNKSFEYAQAVVDMCDIIHKRQVKLLYRLDSIYKFTKLREKGDRMMNIILGMTSKVVKDRKENFQEESRAIVEEISTPVASTPASKKEGLRDDLDDIDENDVGAKRRLALLDAMVEMAKNPDIEWNEKDIMDEVNTIMFEGHDTTSAGSSFALCMMGIHKDIQAKVFAEQKAIFGDNMLRDCTFADTMEMKYLERVILETLRLYPPVPLIARRLDYDLKLASGPYTVPKGTTVIVLQYCVHRRPDIYPNPTKFDPDNFLPERMANRHYYSFIPFSAGPRSCVGRKYAMLKLKVLLSTIVRNYIVHSTDTEADFKLQADIILKLENGFNVSLEKRQYATVA

SEQ ID NO: 4242 - protein, 114 aa, Drosophila melanogaster
MMILLRDSTNLHFHLQADLDGQLTKASGKLVVLDFFATWCGPCKMISPKLVELSTQFADNVVVLKVDVDECEDIAMEYNISSMPTFVFLKNGVKVEEFAGANAKRLEDVIKANI

SEQ ID NO: 4243 - protein, 74 aa, Drosophila melanogaster
MICLLWISVAILVVIHWIYKVNKDYNILAFFARRVQTKDGKPLDSLVPMIKGRTVFANCFDLLGKDTDQVFTHL

SEQ ID NO: 4244 - protein, 82 aa, Drosophila melanogaster
MICLLWISVAILVVIHWIYKVNKDYNILAFFARRVQTKDGKPLDSLVPMIKGRTVFANCFDLLGKDTDQVFTHLRQLAKNSG

SEQ ID NO: 4245 - protein, 253 aa, Drosophila melanogaster
MTSIAKSIVLLASLATFAYSLYVVGSLMMFLSTPRSISKAHTWIFNLLDNKSRLQTAYGPVVFDTLYLIGFIFQHSFLKSAVVKKLLAKLGLSGAERTIYSLTSSLCLHYLIVNWLPAQSIVLWQIDVEQSAPLWWTFVITHGICWVVIFGGSLVMDLPELLGVKQAYYDLKAYGPPISYKSGELRNLYAHVRHPSFVGLSVILFATNVMSVDRLVMALLLTTYMYLAWSTDQKDVAYQKIQLQRKKLELKAK

SEQ ID NO: 4246 - protein, 197 aa, Drosophila melanogaster
MAASQVDQKRALNKLKHDLEPFRTAIVGAYGVLTWEKQYYAGVVFGVISCLYLVLWYLDLSLITLLSLLGVISILLNYAFPMVSRLIFGGVNWDGDQEAKFEDVCGQVCAVKGSLVVWYEYLFNERKSTVFVIVMSLGLLAMAWIGAIINNLLLMYLATLLILMWPGLQNKDIFKAITQRASKIINEKIQCGKRKLQ

SEQ ID NO: 4247 - protein, 50 aa, Drosophila melanogaster
AKRVNVIAHPSQLKMPSVDLNVFLELFPFTIVLDHDMKITLAGEKIVETW

SEQ ID NO: 4248 - protein, 47 aa, Drosophila melanogaster
KMPSVDLNVFLELFPFTIVLDHDMKITLAGEKIVETWILHNPGVNPK

SEQ ID NO: 4249 - protein, 1145 aa, Drosophila melanogaster
MKATRNGGQLLIAPSPQTAARLLPLRTYSNASSLGHHHDRSTLSDGDEEEGGLGYTHTLMYGRYTKDLGEFAKDEARKLKILEKRRKQEDKQRNKELLGKHSTRAKRVSSWIWRHTVARLGEDWVFLALLGIIMALLSFIMDKGISICTNARIWLYRDLTSQPFVQYIAWVSLPVCLILFSAGFVHLIAPQSIGSGIPEMKTILRGVQLKEYLTFKTLVAKVIGLTATLGSGMPLGKEGPFVHIASIVAQLLSKLVTSFQGIYENESRNSEMLAAACAVGVGACFAAPVGGVLFSIEVTTTYFAVRNYWRGFFAAVCGATVFRLLAVWFQNADTVRALFLTNFTTEFPFDPQELFVFALIGLVCGLGGASYVWVHRRYVLFMRSNKRMNKFLQKNRFLYPGFLALLVSSISFPLGTGQFLAGELSTHEQVTQLFSNFTWSRDDLTVEQAAVVTHWMTSYTSVFGNLVIYTLFTFVVSIIASTIPVPSGMFIPVFKIGAGFGRLVGEFMAVTFPHGVRYGGRLSPIMPGGYAVVGAAAFSGSVTHTVSVAVIIFEMTGQITHVVPVMIAVLVANAVAALLQPSIYDSIILIKKLPYLPDLLPSSSGMYSIFVEDFMVRDVKYIWHGISYQKLKEVLKLNKTLRSLPLVDSPDNMILLGSVQRYELIKMIEKHIGREKRMEVAQKWQKEAQERALEEEKKKQEVELKMRRPSRFEVLPAPDILSLRQIANDEMLPPKKRAETMHGSLAPRKSILKKTNSFNLKTYAQPMGHSPSITPYTTITGNSEFRIRSAFEAIFKKSTTLQDVQPDPETGSLSPAASNHEVEVPRTPSTPGVSKKVQLPAQSNWDFVTDQIMLQVNPISTESNKMPAEKDFTDKALSNNGDSSKQSPSIKFKANKVADVNRSPQTAKRCSKIRFANEVGVNGSPTRTKCKIKPENVLGYSIEDVDETTNPESLAESIQKPKSVRLPRERVIDMSPEDQKQWELEEMLKPIDLQKANVHIDPSPFQLVERTSILKVHSLFSMVGINHAYVTKIGRLVGVVGLKELRKAIEDINSNSFVPPTRDEDADEKPAVEKPLLSTNSSDKAVDMTVTSMDSALSNSENCSDIEMEHIKHTDKGTVSLTMPPQESKQSPSADKSNTENGNHA

SEQ ID NO: 4250 - protein, 317 aa, Drosophila melanogaster
MSCNYADGLSAYDNKGILGAPESFDSDEVVAEKCQELAELIKKSGHVVLHTGAGISTSAGIPDFRGPKGVWTLEEKGEKPDFNVSFDEARPTKTHMAIIALIESGYVQYVISQNIDGLHLKSGLDRKYLSELHGNIYIEQCKKCRRQFVSPSAVETVGQKSLQRACKSSMDSKGRSCRSGILYDNVLDWEHDLPENDLEMGVMHSTVADLNIALGTTLQIVPSGDLPLKNLKCGGKFVICNLQPTKHDKKANLIISSYVDVVLSKVCKLLGVEIPEYSEASDPTKQSKPMEWTIPTSNVNTFHRQYKKYVYFIYYLL

SEQ ID NO: 4251 - protein, 128 aa, Drosophila melanogaster
VLDWEHDLPENDLEMGVMHSTVADLNIALGTTLQIVPSGDLPLKNLKCGGKFVICNLQPTKHDKKANLIISSYVDVVLSKVCKLLGVEIPEYSEASDPTKQSKPMEWTIPTSNVNTFHRQYKKYVYFI

SEQ ID NO: 4252 - protein, 132 aa, Drosophila melanogaster
VLDWEHDLPENDLEMGVMHSTVADLNIALGTTLQIVPSGDLPLKNLKCGGKFVICNLQPTKHDKKANLIISSYVDVVLSKVCKLLGVEIPEYSEASDPTKQSKPMEWTIPTSNVNTFHRQYKKYVYFIYYLL

SEQ ID NO: 4253 - protein, 678 aa, Drosophila melanogaster
MDILIFVTAAAHLVYTPFTKVEESFNLQAMHDILYLRNNFTQYDHHDYPGVVPRTFIGPLVVSIISAPFVLLFETLSINKFWAQYVVRLVLAGAISVAWNSLRQAVTKIYGVEVRLWFTAITITQFHFMFYMTRPLPNIFALPIVLFAIAYWLRDQHKPFIICSGISILVFRSELALFLGILLVVSLLRRKVSIDGLLKVALPAGVCILAATVLVDSFFWRRLLWPEGEVLWYNTVLNKSSNWGTSPFLWYFYSALPRAMGASLVLVPIGVALEPRIRPLVLSALLFVLLYSILPHKELRFIIYVFPVLNIAAACACQRIWMNSAKSTWHSFLALACGAHLLLNVFITLFLLVISGTNYPGGAALSRLHRLEAGTSNVSVHISNLAAQSGVSRFMEINNEWTYSKDETMNYTQADLVAYTHLLVEAKNKQNTELWASLQNEFDTLEFIDCFNSIGIQYNSLLPVRIKTKPCIGILKKRPVAPKEASKTKEKIAKTKTYPVEKETLLAPVKEFPKVIGDPKMKSRLQVDADDDDGIVSTVEEMSLELETDTEPHAGAETIETPLKEINFQELRTLALGQATKKSRAATKMKIRQIIEQHYRAKGKQIENDSAETQKTQGKAGLRQSVKSIIKQEKIKEMIEQIATMDLTRICDLERTSTKDCLKQVIDKIDDSEGLKSK

SEQ ID NO: 4254 - protein, 723 aa, Drosophila melanogaster
MTDVPEPVRKCASLLKGTKSDTEKFAALFMVTKLVKGKDCNAAGKKLLFEAIGFPFLKKLLVSKDLPNDCPPLVYKSVALSILTCFCQEEELATHKDIIDAIPTLLEIVEQADDEDYEDNLIVVSEAYSCLKSIASHEPGQQALLATGAIPKMSQIYSAQSFQTDEALHLIVLLVKQFGVVSWPEDPTAFHALIQRIALDMETDDTERKYELCRILADILITCRREIVINSLEGQIWPESLFKGCGDILKAKIGPKQRDPALHLIATTLHVLGIQWAFMDEQKTFFLQLLQLGAIEVRMQMDEKKLETTFKQAELLTCCFSILEHCIEYMATDQLDLEPKEKQTTYTALKGAFNQVLAVLTRVSQDKIRESSNPKDKKFVFAIVKVLSAWLAQETTAMRPAIYKLLPFMLKVANESFQELKTWRAGTREGEPPIDVLRIMLPALCHFAVEEEARRVLFTHKQDEVLLESLEFYFSIAHWKRPPIPRAERLKRMNEPDPVPTPEQQAEMKVARSAIVALCNILMNFTVLEPKKAEDGPTFANLLKFVVENLPELKDTPDNLVIHGNLAVLGLLLLKQQSKKVKQNDFSICRYIQATIRFLWDAYNIDESNDPTALVVSIAYKGYWSDLSELWFLGMQTMCGVLPLVPWLSEFALESGWAEGIVKTLKKVKIGTLPANVKSAYEDFLSQLVDVNGDVQAVLKKADALRVCRNHRMMDLGKKLFGD

SEQ ID NO: 4255 - protein, 94 aa, Drosophila melanogaster
EQVSSPNILGVLLKHLHQMAGMVVPFSALGKTILKRLVVLWSTGDETVRVLAFLCILKITRKQQATMLNHVLKAMYLAYVRNSKFVSPNTLPGI

SEQ ID NO: 4256 - protein, 106 aa, Drosophila melanogaster
KTILKRLVVLWSTGDETVRVLAFLCILKITRKQQATMLNHVLKAMYLAYVRNSKFVSPNTLPGINFMRRSLVEMFALDLNVSYQHVFLYIRQLAIHLRNAVILKKK

SEQ ID NO: 4257 - protein, 673 aa, Drosophila melanogaster
MNLLPKTREEFAQTDYWNEFFKKRGEKAFEWYGEYLELCDQIHKYIKPADRILMLGCGNSKLSMDMYDTGFRDITNIDISPIAVKKMLELNAKSRPEMKFLQMDATAMTFPDESFSVSLDKGTLDALFADDEPETRAVVENYFKEILRTMRNGGRYVGISLLQEHILNFLLDFLPKHNCMLRIVHCLGVEQANKEKNADDALTLPVFVVVATKFKSLPMPVLEFGFGNDKMQRFTTVSELNSAVSSVQKAALVCNGLARSNIAGHNEVIMDLHRPSEQTPRYTIHILDKPPARGLGKYAAFIVPQGREVEWIFSTPAGRKKLQDSANFQRLAVVTLHRDQVYSTLDEVKQELADSIKNLSPAGLTDQIPYLSLGSDVGKRETLICGFSKISGDFRIEEVEANGKTLRRLIFLSNQFVVQSEALVKTVKIKGKKDRKKIDFGYLACQHHLYMSVGVQLATTVQHPKRDVEKDVLVVGLGGGGLCSFLHAALPQARITAVEIDPIMLEVAEQYFELKQDKRFHVVIDDGLDFVERCRNEDIHFDAVLFDVDSKDLSLGMSCPPQSFLATKILQHIKEIIGPKGLFMLNLVCRDESLRTEALNNLHKVFPAVCSYKLEEDINEIIYCANDEKYKTVEQWKKNMGTAGRGLNSAVKETKLASEDALEVAEFLSELKI

SEQ ID NO: 4258 - protein, 124 aa, Drosophila melanogaster
MSDDIKKYLDGLLQKVSGLYVIQITDRDGVPLLRVSQEKNVDFALMPSFIPTFTTACDQASKLGLGRNKTIISMYSNYQVVQMNKLPLILTFVGAENCNTGHILALEHQVDGYLEDIKQAVTEA

SEQ ID NO: 4259 - protein, 370 aa, Drosophila melanogaster
  MOD_RES (24)..(24): Selenocysteine
MFQPEKHGLEPDFQLTKFTTHTGCSCKIPQKVLEKYLRGTEIENKNNDGYLIGSGMDCAVIPLKRHKDYLLIQTVDFFYPMVNDPELLGRIALANVLSDVYAVGVTQFDTVEMIVSTSTSFSEKERDVVIGLVMKGFQNSLKANGYRNTPLIIRQLKINPWCIIGGIATSVCRSEEIILPSNAQPGDVLVLTKPLGGQMAMDAHLWQLNQTEKYKKLLSECSDADIKETFEIAVKSMTYLNKNAALLMHKYQAHCATDITGFGLLGHANNLAQFQKEKVLFQINKLPIIKNVLKFSTLVGQSTKFRSGRSVETSGGLLICLPADAADKFCRDFEEATNGEQKSFQIGHVTAANESDAVLCEDVEFIEVSL

SEQ ID NO: 4260 - protein, 305 aa, Drosophila melanogaster
  MOD_RES (24)..(24): Selenocysteine
MFQPEKHGLEPDFQLTKFTTHTGCSCKIPQKVLEKYLRGTEIENKNNDGYLIGSGMDCAVIPLKRHKDYLLIQTVDFFYPMVNDPELLGRIALANVLSDVYAVGVTQFDTVEMIVSTSTSFSEKERDVVIGLVMKGFQNSLKANGYRNTPLIIRQLKINPWCIIGGIATSVCRSEEIILPSNAQPGDVLVLTKPLGGQMAMDAHLWQLNQTEKYKKLLSECSDADIKETFEIAVKSMTYLNKNAALLMHKYQAHCATDITGFGLLGHANNLAQFQKEKHLGGPKHKVSIWQIGGNLWRPFNMPSC

SEQ ID NO: 4261 - protein, 124 aa, Drosophila melanogaster
KIAVVIYLLYMNLGISAVIGSIACIVIMTPLQFFIGNAMSKNAEVIAGYTDERLKRIHDTLVGIKVIKLNAWDEVFLKKIQEARRKELKYLNKDATFWTLMAVLTHIATVLITFVTLGVYVWLH

SEQ ID NO: 4262 - protein, 124 aa, Drosophila melanogaster
MNLGISAVIGSIACIVIMTPLQFFIGNAMSKNAEVIAGYTDERLKRIHDTLVGIKVIKLNAWDEVFLKKIQEARRKELKYLNKDATFWTLMAVLTHIATVLITFVTLGVYVWLHRDQEFDLNAS

SEQ ID NO: 4263 - protein, 165 aa, Drosophila melanogaster
KFACAPPTFQQSVEHKYAKSSGHYANNASVEVVSMNYIPFGEKSISICVKLYQTTATEDSVVQEQILHDIVKALRTPLAMKYKCLSSSTWKLAISSLISVLHTGLKVARAKPQHFASLWDDLADTLDKFLFPASVCTIEDRGLEEIVLDETIDCQVIELLRDEVL

SEQ ID NO: 4264 - protein, 107 aa, Drosophila melanogaster
VEVVSMNYIPFGEKSISICVKLYQTTATEDSVVQEQILHDIVKALRTPLAMKYKCLSSSTWKLAISSLISVLHTGLKVARAKPQHFASLWDDLADTLDKFLFPASVC

SEQ ID NO: 4265 - protein, 47 aa, Drosophila melanogaster
HTVIAIAIALFSCFTYLVEMRLVMVNKVLKNLAHQWDTRSLKAVNQK

SEQ ID NO: 4266 - protein, 118 aa, Drosophila melanogaster
LVEMRLVMVNKVLKNLAHQWDTRSLKAVNQKQRSLQCLDSFSMYTIVTKDPAEIIQESMEIHHLICEAAATANKYFTYQLLTIISIAFLIIVFDAYYVLETLLGKSKRESKFKTVEFV

SEQ ID NO: 4267 - protein, 165 aa, Drosophila melanogaster
EINTLLKGQHPNIVTVREIVVGSNMDKIFIVMDYVEHDLKSLMETMKNRKQSFFPGEVKCLTQQLLRAVAHLHDNWILHRDLKTSNLLLSHKGILKVGDFGLAREYGSPIKKYTSLVVTLWYRAPELLLCSPVYSTPIDVWSVGCIFAEFLQMLPLFPGKSEIDE

SEQ ID NO: 4268 - protein, 107 aa, Drosophila melanogaster
IVTVREIVVGSNMDKIFIVMDYVEHDLKSLMETMKNRKQSFFPGEVKCLTQQLLRAVAHLHDNWILHRDLKTSNLLLSHKGILKVGDFGLAREYGSPIKKYTSLVVT

SEQ ID NO: 4269 - protein, 148 aa, Drosophila melanogaster
MLRYAVIACAALVVFAGALEFSDCGSKTGKFTRVAIEGCDTTKAECILKRNTTVSFSIDFALAEEATAVKTVVHGKVLGIEMPFPLANPDACVDSGLKCPLEKDESYRYTATLPVLRSYPKVSVLVKWELQDQDGADIICVEIPAKIQ

SEQ ID NO: 4270 - protein, 119 aa, Drosophila melanogaster
KLTNVKKSRSSHAGVLEFVADEGKCYLPHWMMENLLLGEGDILNIESVSLPVATFSKFQPHSTDFLDITNPKAVLENALRNFACLTRGDVIAIKYNKKVYELCVLETKPGNAVSIIECD

SEQ ID NO: 4271 - protein, 115 aa, Drosophila melanogaster
LTNVKKSRSSHAGVLEFVADEGKCYLPHWMMENLLLGEGDILNIESVSLPVATFSKFQPHSTDFLDITNPKAVLENALRNFACLTRGDVIAIKYNKKVYELCVLETKPGNAVSII

SEQ ID NO: 4272 - protein, 386 aa, Drosophila melanogaster
MGNHQVIFLVLCTSLLFQNTIQQNVSFQLIREIDRYTPENFVLSVLNIEMILFEIHAAKAVESNNDLERSLIINFGYSEARQEVLDWGLRYKKASSAKFQMANKVAVSQKLPLSQKLRLVNEVLMTSAKKYDVTKDVRPSKLMDEWLSSHLDGVLANFVQEKKLNAGENIVAISGMTVTPLWASHFQSEINRYFVNNPGTGYASKDPTCVPMMHSLSSFETMSTDEAKGIYIPFSSANLGMLILLPRKGVTCKDILDNLNNQINVEYNDHKDVHLLLPIFKEKFDYNIAKFFNGINIEDTFKDSAFKSKAKIKINNFRVNHGIRFQPILRLEVVDDIDTGKTETFEVNRPFVFVIKDKINVYAVGRIENLDGLTDKVNCSKKYADL

SEQ ID NO: 4273 - protein, 243 aa, Drosophila melanogaster
MSEKKGALKVIPSASEEQLVQALGDLLQRCSQEALAKHDKFSVGLSGGSLVQLLTKALKSCNLKTAKWVFFFCDERYVRLDDSDSTYGAYRAEWLTQLPCIQESQFVRADTSQPLDACAADYEAKVKSQVDRFDLLLLGMGPDGHTCSLFPEQPATLQETKRLVIPIRNSPKPPPERITFTLPLINKARNVAFVVTGAAKASVVKSVFVDLDKKFPAAWVNPTKGQLTLIVDAGAGKEIETLK

SEQ ID NO: 4274 - protein, 168 aa, Drosophila melanogaster
ATGAIKLDDLTPSELIGIYDALFSCLVSWLEGNSMDQVLFTCLYLHAPAQIKDKALRVFCTAVRNLIVVIKKIIAVAAVNEEEDFQLYGNSALLAAEKAQPATVYSSLKDVEDELIRKCKKLTSTEDWMAVVHRLRFMRHLFQVIYHVEQMASNDTVDDKVDIYKILL

SEQ ID NO: 4275 - protein, 31 aa, Drosophila melanogaster
LIRKCKKLTSTEDWMAVVHRLRFMRHLFQVI

SEQ ID NO: 4276 - protein, 331 aa, Drosophila melanogaster
MGSDRTLKKQKMSVLQELKKITTIVADTGDFEAINIYKPTDATTNPSLILSASSMERYQPLVQKAVEYAKGKKGSVSEQVAEAMDYLCVLFGTEILKVVPGRVSTEIDARLSFDTKKSVEKALKLIALYKSLGVDKERILIKLASTWEGIKAAEILENEHGVHCNLTLLFSFAQAVACAEAGVTLISPFVGRILDWYVANTDTKKFEALKDPGVISVTNIYNYYKKFGYKTLVMGASFRNVGEIKALAGCDLLTISPALLKELENETESVVTYLSVSNAKLQDIEKITVDESRFRWLLNEDAMATDKLSEGIRKFAVDTVKLENLIKTYLK

SEQ ID NO: 4277 - protein, 783 aa, Xenopus laevis
MTSIIKLTTLVGAQEESAVCYLLQVDEFRFLLDCGWDENFSMDIIDSVKKYVHQVDAVLLSHPDPLHLGALPYAVGKLGLNCAIYATIPVYKMGQMFMYDLYQSRHNTEDFSLFSLDDVDCAFDKIQQLKYNQIVHLKGKGHGLSITPLPAGHMIGGTIWKIVKDGEEEIVYAVDFNHKREIHLNGCSLEMINRPSLLITDSFNATYVQPRRKQRDEQLLTNVLETLRGDGNVLIAVDTAGRVLELAQLLDQIWRTKDAGLGVYSLALLNNVSYNVVEFSKSQVEWMSDKLMRCFEDKRNNPFQFRHLTLCHGYSDLARVPSPKVVLASQPDLECGFSRELFIQWCQDPKNSVILTYRTTPGTLARFLIDHPSERIIDIELRKRVKLEGKELEEYVEKEKLKKEAAKKLEQSKEADLDSSDDSDVEEDIDQITSHKAKHDLMMKNEGSRKGSFFKQAKKSYPMFPAPEDRIKWDEYGEIIKPEDFLVPELQVTEDEKTKLESGLTNGDEPMDQDLSDVPTKCVSTTESMEIKARVTYIDYEGRSDGDSIKKIINQMKPRQLIIVHGPPDATQDLAEACRAFGGKDIKVYTPKLHETVDATSETHIYQVRLKDSLVSSLKFCKAKDTELAWIDGVLDMRVSKVDTGVILEERELKDEGEDMEMQVDTQVMDASTIAQQKVIKSLFGDDDKEFSEESEIIPTLEPLPSNEVPGHQSVFMNEPRLSDFKQVLLREGIHAEFVGGVLVCNNMVAVRRTETGRIGLEGCLCEDFFKIRELLYEQYAIV

SEQ ID NO: 4278 - protein, 333 aa, Cyprinus carpio
MASTKEKLITHVSKEEPAGPTNKVTVVGVGMVGMAAAISILLKDLTDELALVDVMEDKLKGEAMDLQHGSLFLKTHKIVADKDYSVTANSKVVVVTAGARQQEGESRLNLVQRNVNIFKFIIPNIIKYSPNCILLVVSNPVDILTYVAWKLSGLPRNRVIGSGTNLDSARFRHLMGEKLGIHPSNCHGWVIGEHGDSSVPVWSGVNVAGVFLQGLNPDMGTDKDKEDWKSVHKMVVDSAYEVIKLKGYTSWAIGMSAADLCQSILKNLRKCHPVSTLVKGMHGVNEEVFLSVPCILGNSGLTDVVHMTLKSDEEKQLVKSAETLWGVQKDLTL

SEQ ID NO: 4279 - protein, 332 aa, Python regius
MSLKEKLIENVHKEEHPQAHNKITVVGVGAVGMACAISILMKDLADELALVDVVEDKLKGEMLDLQHGSLFLRTPKIVSGKDYAVTAHSKLVIITAGARQQEGEFRLNLVQRNVNIFKFIIPNVVKYSPHCKLLVVSNPVDILTYVAWKISGFPKHRVIGSGCNLDSARFRHLLGERLGIHPLSCHSWIVGEHGDSSVPVWSGVNVAGVCLKELHPELGTDGDKENWKEVHKQVVDSAYEVIKLKGYTSWAIGLSVADLAETIMKNLRRVHPISTMVKGMHGVKDDVFLSVPCVLGSSGITDVIKMTLKSEEEDKLRKSADTLWGIQKELQF

SEQ ID NO: 4280 - protein, 332 aa, Sceloporus undulatus
MSLKEKLIEKVHTEEHPHAHNKITVVGVGAVGMACAISILMKDLADELALVDVMEDKLKGEMLDLQHGSLFLKTPKIVSGKDYAVTAHSKLVIITAGARQQEGESRLNLVQRNVNIFKFIIPNVVKYSPDCKLLVVSNPVDILTYVAWKISGFPKHRVIGSGCNLDSARFRHLMGERLHINPLSCHGWIVGEHGDSSVPVWSGVNVAGVSLKSLHPEMGADGDKENWKDVHKQVVESAYEVIKLKGYTSWAIGLSVADLAETVMKNLRRVHPVSTMVKGMHGIKDDVFLSVPCVLGYSGITDVVKMTLKPEEEDKLKKSADTLWGIEKELQF

SEQ ID NO: 4281 - protein, 136 aa, Rattus norvegicus
VQYLVYQMLKGLKYIHSAGIVHRDLKPGNLAVNEDCELKILDFGLARHTDAEMTGYVVTRWYRAPEVILSWMHYNQTVDIWSVGCIMAEMLTGKTLFKGKDYLDQLTQILKVTGVPGAEFVQKLKDKAAKSYIQSL

SEQ ID NO: 4282 - protein, 121 aa, Rattus norvegicus
SAGIVHRDLKPGNLAVNEDCELKILDFGLARHTDAEMTGYVVTRWYRAPEVILSWMHYNQTVDIWSVGCIMAEMLTGKTLFKGKDYLDQLTQILKVTGVPGAEFVQKLKDKAAKSYIQSLP

SEQ ID NO: 4283 - protein, 134 aa, Mus musculus
MAPGEKIKAKIKKNLPVRGPQAPTIKDLMHWYCLNTNTHGCRRIVVSRGRLRRLLWIAFTLTAVALIIWQCALLVFSFYTVSVSIKVHFQKLDFPAVTICNINPYKYSAVSDLLTDLDSETKQALLSLYGVKDV

SEQ ID NO: 4284 - protein, 85 aa, Mus musculus
KAKIKKNLPVRGPQAPTIKDLMHWYCLNTNTHGCRRIVVSRGRLRRLLWIAFTLTAVALIIWQCALLVFSFYTVSVSIKVHFQKL

SEQ ID NO: 4285 - protein, 349 aa, Mus musculus
MEVQESGCDPSESGAQEPSPVPSKTAGHYELPWVEKYRPLKLNEIVGNEDTVSRLEVFAREGNVPNIIIAGPPGTGKTTSILCLARALLGPALKDAVLELNASNDRGIDVVRNKIKMFAQQKVTLPKGRHKIIILDEADSMTDGAQQALRRTMEIYSKTTRFALACNASDKIIEPIQSRCAVLRYTKLTDAQVLTRLMNVIEKEKVPYTDDGLEAIIFTAQGDMRQALNNLQSTFSGFGYINSENVFKVCDEPHPLLVKEMIQHCVDANIDEAYKILAHLWHLGYSPEDVIGNIFRVCKTFPMAEYLKLEFIKEIGYTHMKVAEGVNSLLQMAGLLARLCQKTMAPVAS

SEQ ID NO: 4286 - protein, 729 aa, Mus musculus
MQSTSNHLWLLSDILGQGATANVFRGRHKKTGDLYAVKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSVGVTFYHAATGSLPFRPFEGPRRNKEVMYKIITGKPSGAISGVQKAENGPIDWSGDMPLSCSLSQGLQALLTPVLANILEADQEKCWGFDQFFAETSDVLHRMVIHVFSLQHMTAHKIYIHSYNTAAVFHELVYKQTKIVSSNQELIYEGRRLVLELGRLAQHFPKTTEENPIFVTSREQLNTVGLRYEKISLPKIHPRYDLDGDASMAKAVTGVVCYACRTASTLLLYQELMRKGVRWLVELVKDDYNETVHKKTEVVITLDFCIRNIEKTVKVYEKLMKVNLEAAELGEISDIHTKLLRLSSSQGTIESSLQDISSRLSPGGLLADTWAHQEGTHPRDRNVEKLQVLLNCITEIYYQFKKDKAERRLAYNEEQIHKFDKQKLYYHATKAMSHFSEECVRKYEAFKDKSEEWMRKMLHLRKQLLSLTNQCFDIEEEVSKYQDYTNELQETLPQKMLAASGGVKHAMAPIYPSSNTLVEMTLGMKKLKEEMEGVVKELAENNHILERFGSLTMDGGLRNVDCL

SEQ ID NO: 4287 - protein, 113 aa, Mus musculus
YEKISLPKIHPRYDLDGDASMAKAVTGVVCYACRTASTLLLYQELMRKGVRWLVELVKDDYNETVHKKTEVVITLDFCIRNIEKTVKVYEKLMKVNLEAAELGEISDIHTKLL

SEQ ID NO: 4288 - protein, 166 aa, Mus musculus
YDLDGDASMAKAVTGVVCYACRTASTLLLYQELMRKGVRWLVELVKDDYNETVHKKTEVVITLDFCIRNIEKTVKVYEKLMKVNLEAAELGEISDIHTKLLRLSSSQGTIESSLQDISSRLSPGGLLADTWAHQEGTHPRDRNVEKLQVLLNCITEIYYQFKKDKA

SEQ ID NO: 4289 - protein, 170 aa, Mus musculus
VHTVFTKKEEKKEWRKTLEPWKLYATVGLLVGMDILTLAIWQIVDPLHRTIETFAKEEPKEDIDVSILPQLEHCSSKKMNTWLGIFYGYKGLLLLLGIFLAYETKSVSTEKINDHRAVGMAIYNVAVLCLITAPVTMILSSQQDAAFAFASLAIVFSSYITLVVLFVPKM

SEQ ID NO: 4290 - protein, 170 aa, Mus musculus; identical to SEQ ID NO: 4289

SEQ ID NO: 4291 - protein, 111 aa, Cricetulus griseus
KQLHSLKTLDCSFNHIETSKGIMQHFPKSLAFLNLTNNPFACICEHQNFLQWVKDQRLFLVKTEQMTCATPVEMKDSLVLDFRNATCYVQKTIISVSVISVLVVSTIAFLV

SEQ ID NO: 4292 - protein, 124 aa, Cricetulus griseus
LHSLKTLDCSFNHIETSKGIMQHFPKSLAFLNLTNNPFACICEHQNFLQWVKDQRLFLVKTEQMTCATPVEMKDSLVLDFRNATCYVQKTIISVSVISVLVVSTIAFLVYKFYFHLILIAGCKK

SEQ ID NO: 4293 - protein, 156 aa, Mus musculus
TKTFGEEFKKTHRHHKTFLDHLKGCCSCSSQKAKKIALSLFPIASWLPAYKIKEWLLSDIVSGISTGLVAVLQGLAFALLVNIPPAYGLYAAFFPVITYFFLGTSRHISVGPFPVLSMMVGVVVTRVVSDPNASSELSSSSTENDSFIEEKVMVAA

SEQ ID NO: 4294 - protein, 117 aa, Mus musculus
KKTHRHHKTFLDHLKGCCSCSSQKAKKIALSLFPIASWLPAYKIKEWLLSDIVSGISTGLVAVLQGLAFALLVNIPPAYGLYAAFFPVITYFFLGTSRHISVGPFPVLSMMVGVVVT

SEQ ID NO: 4295 - protein, 88 aa, Mus musculus; identical to SEQ ID NO: 1404

SEQ ID NO: 4296 - protein, 48 aa, Mus musculus; identical to SEQ ID NO: 1405

SEQ ID NO: 4297 - protein, 314 aa, Rattus norvegicus
MAFVTRQFVRSMSSSSSASAAAKKILIKHVTVIGGGLMGAGIAQVAAATGHTVVLVDQTEDILAKSKKGIEESLKRMAKKKFTENPKAADEFVEKTLSSLSTSTDAASVVHSTDLVVEAIVENLKLKNELFQRLDKFAAEHTIFASNTSSLQITNIANATTRQDRFAGLHFFNPVPMMKLVEVIKTPMTSQKTFESLVDFCKTLGKHPVSCKDTPGFIVNRLLVPYLIEAIRLHERGDASKEDIDTAMKLGAGYPMGPFELLDYVGLDTTKFILDGWHEMDPENPLFQPSPSMNNLVAQKKLGKKTGEGFYKYK

SEQ ID NO: 4298 - protein, 137 aa, Mus musculus
TVYKAHHVPSGKILAVKVILLDITLELQKQIMSELEILYKCDSSYIIGFYGAFFVENRISICTEFMDGGSLDVYRKIPEHVLGRIAVAVVKGLTYLWSLKILHRDVKPSNMLVNTGGQVKLCDFGVSTQLVNSIAKT

SEQ ID NO: 4299 - protein, 145 aa, Mus musculus
KAHHVPSGKILAVKVILLDITLELQKQIMSELEILYKCDSSYIIGFYGAFFVENRISICTEFMDGGSLDVYRKIPEHVLGRIAVAVVKGLTYLWSLKILHRDVKPSNMLVNTGGQVKLCDFGVSTQLVNSIAKTYVGTNAYMAPE

SEQ ID NO: 4300 - protein, 137 aa, Mus musculus; identical to SEQ ID NO: 4298

SEQ ID NO: 4301 - protein, 145 aa, Mus musculus; identical to SEQ ID NO: 4299

SEQ ID NO: 4302 - protein, 108 aa, Thermotoga maritima
AIASVIVHEPDILILDEPLVGLDREGKTDLLRIVEKWKTLGKTVILISHDIETVINHVDRVVVLEKGKKVFDGTRMEFLEKYDPRFFTSKMLVMRRLVLKGEDPFSMS

SEQ ID NO: 4303 - protein, 70 aa, Thermotoga maritima
LLRIVEKWKTLGKTVILISHDIETVINHVDRVVVLEKGKKVFDGTRMEFLEKYDPRFFTSKMLVMRRLVL

SEQ ID NO: 4304 - protein, 369 aa, Thermotoga maritima
MEFEVKKTFGKARLGVMKLHHGAVETPVFMPVGTNASVKLLTPRDLEEAGAEIILSNTFHLMLKPGVEIIKLHRGLHNFMGWKRPILTDSGGFQVFSLPKIRIDDEGVVFRSPIDGSKVFLNPEISMEVQIALGSDICMVFDHCPVPDADYEEVKEATERTYRWALRSKKAFKTENQALFGIVQGGIYPDLRRESALQLTSIGFDGYAIGGLSIGEERSLTLEMTEVTVEFLPEDKPRYFMGGGSPELILELVDRGVDMFDSVFPTRIARHGTALTWNGKLNLKASYNKRSLEPVDERCGCYTCKNFTRSYIHHLFDRGEVLGQILLTIHNINFMISLMKEVRRSIESGTFKELKSKVVEVYSSGGVNV

SEQ ID NO: 4305 - protein, 132 aa, Thermotoga maritima
VKKTFGKARLGVMKLHHGAVETPVFMPVGTNASVKLLTPRDLEEAGAEIILSNTFHLMLKPGVEIIKLHRGLHNFMGWKRPILTDSGGFQVFSLPKIRIDDEGVVFRSPIDGSKVFLNPEISMEVQIALGSD

SEQ ID NO: 4306 - protein, 103 aa, Thermotoga maritima
KTFGKARLGVMKLHHGAVETPVFMPVGTNASVKLLTPRDLEEAGAEIILSNTFHLMLKPGVEIIKLHRGLHNFMGWKRPILTDSGGFQVFSLPKIRIDDEGVV

SEQ ID NO: 4307 - protein, 339 aa, Thermotoga maritima
MIRAGIIGATGYTGLELVRLLKNHPEAKITYLSSRTYAGKKLEEIFPSTLENSILSEFDPEKVSKNCDVLFTALPAGASYDLVRELKGVKIIDLGADFRFDDPGVYREWYGKELSGYENIKRVYGLPELHREEIKNAQVVGNPGCYPTSVILALAPALKHNLVDPETILVDAKSGVSGAGRKEKVDYLFSEVNESLRPYNVAKHRHVPEMEQELGKISGKKVNVVFTPHLVPMTRGILSTIYVKTDKSLEEIHEAYLEFYKNEPFVHVLPMGIYPSTKWCYGSNHVFIGMQMEERTNTLILMSAIDNLVKGASGQAVQNMNIMFGLDETKGLEFTPIYP

SEQ ID NO: 4308 - protein, 470 aa, Mentha piperita
MAPTEIKTLSFLDSSKSNYNLNPLKFQGGFAFKRKDSGCTAAKRVHCSAQSQSPPPAWPGRAFPEPGRMTWEGPKPISVIGSTGSIGTQTLDIVAENPDKFRIVALAAGSNVTLLADQVKAFKPKLVSVKDESLISELKEALAGFEDMPEIIPGEQGMIEVARHPDAVTVVTGIVGCAGLKPTVAAIEAGKDIALANKETLIAGGPFVLPLAKKHNVKILPADSEHSAIFQCIQGLPEGALRRIILTASGGAFRDLPVEKLKEVKVADALKHPNWNMGKKITVDSATLFNKGLEVIEAHYLFGAEYDDIEIVIHPQSIIHSMVETQDSSVLAQLGWPDMRLPILYTLSWPERIYCSEITWPRLDLCKVDLTFKKPDNVKYPSMDLAYAAGRAGGTMTGVLSAANEKAVEMFIDEKIGYLDIFKVVELTCDKHRSEMAVSPSLEEIVHYDQWARDYAATVLKSAGLSPALV

SEQ ID NO: 4309 - protein, 162 aa, Arabidopsis thaliana
MAPIAVGDVVPDGTISFFDENDQLQTASVHSLAAGKKVILFGVPGAFTPTCSMKHVPGFIEKAEELKSKGVDEIICFSVNDPFVMKAWGKTYPENKHVKFVADGSGEYTHLLGLELDLKDKGLGVRSRRFALLLDDLKVTVANVESGGEFTVSSADDILKAL

SEQ ID NO: 4310 - protein, 341 aa, Arabidopsis thaliana
MVVLPQPVTLDNHISLIPTYKPVPVLTSHSIPVVNLADPEAKTRIVKACEEFGFFKVVNHGVRPELMTRLEQEAIGFFGLPQSLKNRAGPPEPYGYGNKRIGPNGDVGWIEYLLLNANPQLSSPKTSAVFRQTPQIFRESVEEYMKEIKEVSYKVLEMVAEELGIEPRDTLSKMLRDEKSDSCLRLNHYPAAEEEAEKMVKVGFGEHTDPQIISVLRSNNTAGLQICVKDGSWVAVPPDHSSFFINVGDALQVMTNGRFKSVKHRVLADTRRSRISMIYFGGPPLSQKIAPLPCLVPEQDDWLYKEFTWSQYKSSAYKSKLGDYRLGLFEKQPLLNHKTLV

SEQ ID NO: 4311 - protein, 477 aa, Arabidopsis thaliana
MMTLNSLSPAESKAISFLDTSRFNPIPKLSGGFSLRRRNQGRGFGKGVKCSVKVQQQQQPPPAWPGRAVPEAPRQSWDGPKPISIVGSTGSIGTQTLDIVAENPDKFRVVALAAGSNVTLLADQVRRFKPALVAVRNESLINELKEALADLDYKLEIIPGEQGVIEVARHPEAVTVVTGIVGCAGLKPTVAAIEAGKDIALANKETLIAGGPFVLPLANKHNVKILPADSEHSAIFQCIQGLPEGALRKIILTASGGAFRDWPVEKLKEVKVADALKHPNWNMGKKITVDSATLFNKGLEVIEAHYLFGAEYDDIEIVIHPQSIIHSMIETQDSSVLAQLGWPDMRLPILYTMSWPDRVPCSEVTWPRLDLCKLGSLTFKKPDNVKYPSMDLAYAAGRAGGTMTGVLSAANEKAVEMFIDEKISYLDIFKVVELTCDKHRNELVTSPSLEEIVHYDLWAREYAANVQLSSGARPVHA

SEQ ID NO: 4312 - protein, 317 aa, Solanum lycopersicum
MVCPNSNPVVEKVCELYEQISRLENLSPSKDVNVLFTDLVHTCMPPNPIDVSKLCQKIQEIRSHLIKLCGQAEGLLESHFSKILSSYENPLQHLHIFPYFDNYIKLSLLEYNILTKNTTNIPKKIAFIGSGPLPLTSLVLATKHLKTTCFHNYDIDVDANFMASALVAADPDMSSRMTFHTADVMDVTCALKDYDVVFLAALVGMDKEDKVKVVDHLAKYMSPGATLMLRSAHGARAFLYPVLDPRDLRGFEVLSVYHPTDEVINSVIIARKLPVPSVPLLDGLGAYVLPSKCACAEIHAFNPLNKMNLVEEFALEE

SEQ ID NO: 4313 - protein, 361 aa, Ocimum basilicum
MSSTANNPQINSDEEENFLFAMQLASASVLPMVLKSAIELDLLELIKKAGAGAFVSPAELAAQLLTTNAEAHVMLDRILRLLTSYAILECRLKTLPDGGVQRLYGLAPVCKFLTKNEDGVSMAPLALMNQDKVLMESWYHLKDAVLDGGIPFNKAYGMTAFEYHGTDPRFNKVFNQGMSNHSTITMKKILETYTGFDGLKTVVDVGGGTGATLNMIISKYPSIKGINFDLPHVVEDAPSYPGVEHVGGDMFVSVPKGDAIFMKWICHDWSDAHCVKFLKKCYEALPENGKVILAECVLPEAPDTGLATKNVVHIDVIMLAHNPGGKERTEKEFQVLAKASGFKQFNKVCCAYNSWIMELLK

SEQ ID NO: 4314 - protein, 361 aa, Ocimum basilicum
MGSATNTPQINSDEEENFLFAMQLASASVLPMVLKSAIELDLLELIKKSGAGAFVSPVDLAAQLPTTNPDAHVMLDRILRLLTSYAILECRLKTLPDGGVERLYGLAPVCKFLTKNEDGVSMAPLTLMNQDKVLMESWYHLSDAVVDGGIPFNKAYGMTAFEYHGTDPRFNKVFNQGMSNHSTITMKKILETYTGFDGLKTVVDVGGGTGATLNMIVSKYPSIKGINFDLPHVIEDAPSYPGVEHVGGDMFVSVPKGDAIFMKWICHDWSDEHCVKFLKNCYDALPQNGKVILAECVLPEAPDTGLATKNVVHIDVIMLAHNPGGKERTEKEFQGLAKAAGFKQFNKACCAYNTWIMELLK

SEQ ID NO: 4315 - protein, 97 aa, Pelargonium hortorum
PLELIYFVKKSAVFPYRWVLVQFGAFIVLCGATHLINLWTFNMHSKTVEIVMTTAKIMTAVVSCATALMLVHIIPDLLSVKTRELFLKNKAAELDRE

SEQ ID NO: 4316 - protein, 82 aa, Pelargonium hortorum
KKSAVFPYRWVLVQFGAFIVLCGATHLINLWTFNMHSKTVEIVMTTAKIMTAVVSCATALMLVHIIPDLLSVKTRELFLKNK

SEQ ID NO: 4317 - protein, 97 aa, Pelargonium hortorum
SIPLELIYFVKKSAVFPYKWVLVQFGAFIVLCGATHLINLWTFNLHTRTVEIVMTTAKLMTAAVSCVTALMLVHIIPDLLSVKTRELFLKNKAAELD

SEQ ID NO: 4318 - protein, 86 aa, Pelargonium hortorum
IYFVKKSAVFPYKWVLVQFGAFIVLCGATHLINLWTFNLHTRTVEIVMTTAKLMTAAVSCVTALMLVHIIPDLLSVKTRELFLKNK

SEQ ID NO: 4319 - protein, 697 aa, Arabidopsis thaliana
MIHTKTGSGRRILTFPTVEPSESISIVTLLDSLIQLAGDILTFKSKHFSTNKQSFRETLRRIQNLLVVFEEIRIRIRNSRRYFHDSAAASSLKEIHVGFQKLKFLLEDCTRDGARLCMMMNSDQVSDHLRVLTRSISTSLSAFPVASVDLTTEVNELIDLVVRQARKYGVQPETNDKRAVSSINRILALFVNRVVPDPDEINRILDHVGIRKWGDCVKEINFLGEEIDAERLDEKKKKSSDQVELLSSLMGFICYCRCIILGRIERDDHHNHHEDGIKKDHDLIRGLKVEDLLCPISLEIMTDPVVIETGHTYDRSSITKWFGSGNITCPITGKILTSTELVDNVSVRQVIRKHCKTNGIVLAGISRRRKSHDDVVPESLAAKGAGKLIAKFLTSELINGGEEMIYRAVREIRVQTKTSSFNRSCLVKAGAVTPLLKLLSSVDIRIQENAMAGILNLSKHVTGKSKIAGEGLKILVEILNEGAKTETRLYSASALFYLSSVEDYSRLIGENPDAIPGLMNIVKGDDYGDSAKRSALLAVMGLLMQSDNHWRVLAAGAVPILLDLLRSGEISGGLTADCLATLAKLAEYPDGTIGVIRRGGLKLAVKILSSSEDSPVAVKQHCVGLILNLCLNGGRDVVGVLVKNSLVMGSLYTVLSNGEYGGSKKASALIRMIHEFQERKTGSVEPNLQRGRFVHAW

SEQ ID NO: 4320 - protein, 391 aa, Citrus sinensis
MATVQEIRNAQRADGPATVLAIGTATPAHSVNQADYPDYYFRITKSEHMTELKEKFKRMCDKSMIKKRYMYLTEEILKENPNMCAYMAPSLDARQDIVVVEVPKLGKEAATKAIKEWGQPKSKITHLIFCTTSGVDMPGADYQLTKLIGLRPSVKRFMMYQQGCFAGGTVLRLAKDLAENNKGARVLVVCSEITAVTFRGPADTHLDSLVGQALFGDGAAAVIVGADPDTSVERPLYQLVSTSQTILPDSDGAIDGHLREVGLTFHLLKDVPGLISKNIEKSLSEAFAPLGISDWNSIFWIAHPGGPAILDQVESKLGLKGEKLKATRQVLSEYGNMSSACVLFILDEMRKKSVEEAKATTGEGLDWGVLFGFGPGLTVETVVLHSVPIKA

SEQ ID NO: 4321 - protein, 389 aa, Citrus sinensis
MVTVDEVRKAQRAQGPATIMAIGTATPPNCVDQSTYPDYYFRITNSEHMTDLKEKFKRMCDKSMIKKRYMYLTEEILKENPNVCAYMAPSLDTRQDMVVVEVPRLGKAATEAIKEWGQPKSKITHLVFCTTSGVDMPGADYRLTKLLGLRPSVKRLMMYQQGCFAGGTVLRLAKDLAENNKGARVLVVCSEITAVTFRGPSDTHLDSLVGQALFGDGAAAIIIGADPIPEIEKPMFELVSTAQTILPDSDGSIDGHLREAGLTFHLLKDVPGLISKNIQKSLTEAFKPLGISDWNSIFWIAHPGGPAILDQVEEKLGLKPEKLRATRHVLSEYGNMSSACVLFILDEMRKKSAEDGLETAGEGLEWGVLFGFGPGLTVETVVLHSVAAA

SEQ ID NO: 4322 - protein, 519 aa, Dictyostelium discoideum
MQLEKMLTEVNIERSKFNTYNVLLQYIKAVTQKYNLNKVSSKYGKVLFIKDGVVKVSGLSQIKIGEKVEFVGKNLYGMALNLEATSVGIVIFGEDTAIYEGVIVKRCEQNFAIKVDKTMLGRVVDVLGQPIDGLGELKDTKTTRVMSVERKAPGIVTRKSVHESMLTGVKIVDALLPIGRGQRELIIGDRQTGKSAIAVDAILNQQVNKDIVCIYVAVGQKKSTVRRLVEMLNTKGALEYTIVVVSTASDAAPLQFLAPYTGCTIGEYFRDEGKHALIVYDDLSKHAVAYRQMSLLLRRPPGREAYPGDVFYIHSRLLERAAKLNEKYGCGSLTAFPIVETQAGDVSAYIPTNIISITDGQIFLEKELFNKGIRPAVNVGLSVSRVGSAAQSAVMKKLAGALKLELAQYRELARFEQFSSNADAVTTQILKKGKLTIELLKQVNNNPMSIGLEALMIYAMGTSYFQNLDLSLVRSEETKLLNYINSIASFKLYAACVDAVKAFNPKDTVFAEMCQSYVK

SEQ ID NO: 4323 - protein, 237 aa, Bos taurus
MAVEGGMKCVKFLLYVLLLVFCACAVGLIAVGVGTHLVLNQTITHGATPSFLLPVVIIAVGAFLFLVAFVGCCGACKENYCLMITFAIFLSLIMLVEVAAAIAGYVFRDKVRSEFNKDFRQQMKNYPKDNQTASILDKMQKDFECCGAANYTDWEKILAVTNKVPDSCCVNITHNCGINFVVKDIHTEGCVEKIAAWLRKNVLVVAAAALGIAFVEILGIVLACCLVKSIRSGYEVM

SEQ ID NO: 4324 - protein, 401 aa, Oryctolagus cuniculus; identical to SEQ ID NO: 1533

SEQ ID NO: 4325 - protein, 408 aa, Oryctolagus cuniculus
MHLYKPACADIPSPKLGLPKSSESALKCRRHLMVTKTQPQAACWPVRPSGPTERKHLERFLCVHGVSLQETTKAETGMAYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 4326 - protein, 528 aa, Macaca fascicularis
MSMKWTSALLLIQLSCYLSFGSCGKVLVWPTEFSHWMNIKTILDELVQRGHEVTVLAYSTSILPDPNNPSPLKFEICPTSLTETEFQDSVTQLVKRWSDIRKDTFWPHFLHVQEMMWTYGDMIRKFCKDVVSNKKLMKKLQESRFDVVLADAISPCGELLAELLKIPFVYSLRFSPGYALEKHGGGFLFPPSYVPVTMSELRDQMTFMERVQNMIYMVYFDFWFQVWDVKNWDQFYSKVLGRPTTLFEIMAKAEIWLIRNYWDFQFPHPLLPNVEFVGGLHCKPAKPLPKEMEEFVQSSGDNGVVVFSLGSMVSNMSEERANVIASALAKIPQKVLWRFDGNKPDTLGLNTQLYKWLPQNDLLGHPKTRAFITHGGANGIYEAIYHGIPMVGVPLFADQPDNIAHMKAKGAAVRLDFDTMSSTDLLNALKTVINDPIYKENAMKLSSIHHDQPVKPLDRAVFWIEFVMRHKGAKHLRVAAHDLTWFQYHSLDVIGFLLACVATVIFIITKCLFCVWKFVRTRKKGKRD

SEQ ID NO: 4327 - protein, 131 aa, Macaca fascicularis
IKTILDELVQRGHEVTVLAYSTSILPDPNNPSPLKFEICPTSLTETEFQDSVTQLVKRWSDIRKDTFWPHFLHVQEMMWTYGDMIRKFCKDVVSNKKLMKKLQESRFDVVLADAISPCGELLAELLKIPFV

SEQ ID NO: 4328 - protein, 47 aa, Macaca fascicularis
KGAKHLRVAAHDLTWFQYHSLDVIGFLLACVATVIFIITKCLFCVWK

SEQ ID NO: 4329 - protein, 334 aa, Monodelphis domestica
MATLKEKLIAPVAEEEAAAPNNKITVVGVGQVGMACAISILGKSLADELALVDVLEDKLKGEMMDLQHGSLFFQTPKIVADKDYSVTAGSKIVVVTAGVRQQEGESRLNLVQRNVNVFKFIIPQIVKYSPDCTIIVVSNPVDILTYVTWKLSGLPKHRVIGSGCNLDSARFRYLMSEKLGIHPSSCHGWILGEHGDSSVAVWSGVNVAGVSLQELNPEMGTDNDSENWKEVHKLVIESAYEVIKLKGYTNWAIGLSVADLIETMLKNLSRIHPVSTMVKGMYGIENEVFLSLPCILNARGLTSVINQKLKDDEVAQLKKSADTLWDIQKDLKDL

SEQ ID NO: 4330 - protein, 332 aa, Monodelphis domestica
MGTVKDQLILNVLKEEQTPHNKITVVGVGAVGMACAISILMKDLADELALVDVIEDKLKGEMMDLQHGSLFLKTPKIVSSKDYAVTANSKLVVITAGARQQEGESRLNLVQRNVNIFKFIIPNIVKYSPNCKLLVVSNPVDILTYVAWKLSGFPKNRVIGSGCNLDSARFRYLMGEKLGIHSSSCHGWILGEHGDSSVPVWSGVNVAGVSLKSLHPALGTDSDSEQWKDVHKQVVESAYEVIKLKGYTSWAIGLSVADLAESIMKNLRRVHPISTMIKGLYGINEDVFLSVPCILGQNGISDVVKVTLTTEEESRLKQSADTLWGIQKELQF

SEQ ID NO: 4331 - protein, 240 aa, Caenorhabditis elegans
MSFEKLQKELHEAIEGVNRYNPENVADLAACVQAMVNENKYDKDIVLTILKLYQLNPEKYDEAVVRQVLLKTLMVLPSSDFALAKCLIDTNRLGSQELRRIFDLGAVLESCNFAVFWKLVKGAYKPTTNPNEPFKVPGEVPKMIKPMVGFEDAVKHYACRVISVTFQKIEKKMLSRLLGGASDKEVTALAQSFGWEAKENGDVFFVANHEGTIKTRNIDEKIQFPHVADLLTSIQPPLTL

SEQ ID NO: 4332 - protein, 384 aa, Caenorhabditis elegans
MSSATSGEYWLISVPGEKGANDAWDKLNRSTGNTSTNSKYLIPDLKVGTLDQLVGLSDDLSKLDTSAEAVIRKLVQYFTEVLEEDKSKIAENLVIGNKDMKTYVTKFQWEGAKYPLKQSLKVLSEIIGKQISQIDNDLKVKSLTYNNLKNALASMDRKTVGSLLTKDLADLVKADDFVLNSEYLQTVIVVVPKISVKEWEQKYATLSSMVVPGSSKLLTEEGEHALYTVTLFKKVIDEFKNTARENKFIVRDFVYDEETLKAGRTERDKLMAEKQRQYAPLIRWLKINFGEIFAAYIHIKALRVFVESVLRYGLPVNFQAAVIEPAKGQQKKLRQELHKLYIHLDGSAAGPIDTLEDSPALMSLGVNEYYPYVFFKLNIDFLNK

SEQ ID NO: 4333 - protein, 822 aa, Toxoplasma gondii
MAAKPEQDCKTAAALIRAGSLIEGVESAGKDFLVWTTQGPAVKKDPDLLFSLCRVLPGSTQQTLKLQQVEPTADSQELTVQAKEVWQANPGIDPLTYGDIGGLPHTNEPCVLDFLARRYQSKVIYTTAEPLIVAVNPFQDLKNAGPDTIALYRDAPDVDKLPPHVFYASRRAMTNMHQLKKPQTIIVSGESGAGKTETTKMLMKYLATSAGGNLDLKIQTAIMAANPVLEAFGNAKTVRNNNSSRFGRFMLLDVAREGGIQHGKVVAFLLEKSRIVCQDKDERNYHIFYQFLKGAPGHMRQRYMLQPLEAYTFINPHCLDAPGIVDTEDFEQTVKSLESMNMTETETCTIWSIVSGVLLMGNAKPTGKTEAGVENAACFVGESEAALRNACSLLFLDYPSILHELTVKTTYAGSNKIESRWTVPDSEMLRASLAKGMFEQLFLWIIRKLNADIEPKGGSFDVFMGLLDIFGFEVFQNNSLEQLFINITNEVLQRNFTDIVFEKELQLYSKEGISSKKIEYTTNEKLIETLLGKGTSVLAALEDQCISPSGTDEKFVSSLASKLAGNKCFIPSKNTKSLEFTVVHTIGKVIYNADGFAFKNKDVLRPEIIEITRASTNDVVRGLFEGVKVEKGKMAKGMLIGSQFMTQLKGLMEVIQKTESHFIRCIKPNDDKVPLKWVNSKVLIQLHALSILEALHLRQLAFSYRRTFEEFAAQFRFINLGVSNKPGADAKTICVELLKSTSISADEYALGKTMVFLKPQAAKMLVRLQREALSAWEPLVGVFEGMTVLKRAKQLSTGRAVPATRICANVRRKLVQAGIKVC

SEQ ID NO: 4334 - protein, 64 aa, Schizosaccharomyces pombe
KLTKLWKIVVMTVSFLVGAWLIIFYVLRKLSNKHTWMVPVLGLGFGAIKWMHVFWGTSNVGIFL

SEQ ID NO: 4335 - protein, 129 aa, Schizosaccharomyces pombe
SKDELLRTDSANLLTLNDNDEPVMIRHSCKRTCILFATLEYNIPEWNIKIKIGGLGVMAELMSKTLKQYDLVWVVPCVGDITYPVAETAPSLVVKVVNQDYEVKVFYHYKDNIKYVLLDSPIFRKRTSH

SEQ ID NO: 4336 - protein, 258 aa, Schizosaccharomyces pombe
MYDDIFFYLALWVIQSVYGAWDWAKNWVFWTCSYLLNFLYHHHCSRDLIRRDTKKLKKKPKHIAVIIECVEDGGIEGLIHDACELSAWCVCSNIRELTIYERKGFLKQSPEAVEKAIYSHLPFYLGGDKCTVHVTNPCSPDEKNQNDCVDLKVHLIAKEDGRDAIIDLTRGLADLCTKKVISSTQVTLELIDKELKESVIPEPDLLIIFAPLLKLQGFPPWQLRLCEIFHDPILYTTNYLTFFKALVHYSNAEMRLGH

SEQ ID NO: 4337 - protein, 331 aa, Schizosaccharomyces pombe
MVTASSSVRVSNEDECFIYDIEQLKDNVVVSYSTGSWSCFDKGTLLEIFKVPKAHTNITGIISCDQLNGVITCGSEGEIHLWDIRSQAKSAVRSWTQQSTPFTCIALNKKNQFATGSELTRSLASVQLWDVRSEQKLIRQWNDAHNDDITHLQFHPKDNELLLTGSVDGLVSLLDTTKEEDSTDPEEDPLLHVINHGASIHLAKFVSKKRVMVLSHMESYAMYKLKRDKDEKTWSSNELFSIDDLRAELSCSYVINEVSTSDKQFCALAFGDFSNHETKFVLVDTSTGELKKEPTKLERASEEICRAISFDVKNDVYYSGGEDGLLQAFRV

SEQ ID NO: 4338 - protein, 87 aa, Schizosaccharomyces pombe
NALKGPVASVELLVGVLCLGCGDSMASIIGKRFGKHRISKTNKSIEGVFAFSISVFLVLHLTQAFHVCPSVTFWKTLFMSLCTAILE

SEQ ID NO: 4339 - protein, 75 aa, Schizosaccharomyces pombe
LKGPVASVELLVGVLCLGCGDSMASIIGKRFGKHRISKTNKSIEGVFAFSISVFLVLHLTQAFHVCPSVTFWKTL

SEQ ID NO: 4340 - protein, 58 aa, Schizosaccharomyces pombe
IQNPVRKSVAKAWVSVFEKIIEKAKLEGVQGLEDLNSTSLALQLEHIMFMVLSYTTDH

SEQ ID NO: 4341 - protein, 50 aa, Schizosaccharomyces pombe
VAKAWVSVFEKIIEKAKLEGVQGLEDLNSTSLALQLEHIMFMVLSYTTDH

SEQ ID NO: 4342 - protein, 116 aa, Schizosaccharomyces pombe
IPNLNLLLGENVASYSFKHGMADMLNSLASTPSPLPILFDQCVHTVKLEDNTVNLSFVNETTVSVDKVVICIPMDKLNTHLITFEPPLEEKKLKAIDRCHFTNVKKVILIFKTQFW

SEQ ID NO: 4343 - protein, 112 aa, Schizosaccharomyces pombe
LLLGENVASYSFKHGMADMLNSLASTPSPLPILFDQCVHTVKLEDNTVNLSFVNETTVSVDKVVICIPMDKLNTHLITFEPPLEEKKLKAIDRCHFTNVKKVILIFKTQFWE

SEQ ID NO: 4344 - protein, 141 aa, Mustelus griseus
MAFTACEKQTIGKIAQVLAKSPEAYGAECLARLFVTHPGSKSYFEYKDYSAAGAKVQVHGGKVIRAVVKAAEHVDDLHSHLETLALTHGKKLLVDPQNFPMLSECIIVTLATHLTEFSPDTHCAVDKLLSAICQELSSRYR

SEQ ID NO: 4345 - protein, 1364 aa, Xenopus laevis
MTFHFHIPLAFRDLLKSGGIGQYVVQEVLPVRHVDAQFAAFQTSFRTEAPLCILQHFDTLYSILHHFRSLDIAIKEDVLEVMVKVASRHANELPAILEDLNLSVPQRAAHLNALKMNCFILTQLIEAFEAETYKASLGSVEPSGKGKKAKSKPEGFSWESERESILQALTHLLQLDIRRLWSMSVVEEEFVSMMTSCCYKMMENPNIVMAKNKSTREALGHLLGVTVKRYNHMLSASVKVIQLLQHFEHLASVLVHTVSLWATEYGMKPVIGEIMREIGQKCSQDLSRESSGFKAFATFLTELAERIPAIMMPSISVLLDYLDGENYMMRNSVLTVMGEMVVRVLSGDQLEEAEKSSRDQFLDTLQEHLHDVNTYVRSCVIQIYNRIVQEKALPLSRFQSVVTLVVGRLFDKSVNVCKNAIQLLASFLANNPFTCKLSSVDLKVPLEKETKKLKEMREKYQGPKPVVVISPEEEWEAMLPEVLEAFKILQQESKEEEDIETEEIESSQHLREQILILLRKTSYKNSIRLTQKGIERFQEDPLFSEGDSEAKSELGILEKIFTEKKADLEQPTTKDQDDAQVNPTSEELPSQEVQNSDMDKQEMLVQYLSDAHHFALKIEEAIDVISKMMYETAVSVVQEVIEFFVTVSQFGVSQALLGVRRMLPLVWSKEPGVREAVLSAYRRLYLSSNGESERVKAQALVRSLSLLMVDSSAGILQCLEEIVSEFVQKGDIHPSVIQLLWEKFTQKSPCSEFERRAAVMLLGMMTRGQPEIVMSNLDTLVSVGLGEQVQKDYQLAREVCNCILKITDSQKQTLGKSTEPFRLPKDHSLFVCLTEAVAGGIGLSGLHWLPFKETAVRLVYELGEEPEEICSEILLRCSQNVLDGHQTQDEVPNVPAFLLTHLLSLAGDVALQQVVHLERAVSAELRRRRVLKEEQEAEKVGKQRKSKANESTMEEELGLVGASADDIEAELIRKICDTELLGGQQYLSAFLPLILRICNNPGRYSDPDLCTVATLALAKYMMISSDFCDTHLRLLFTLLEKSPLPSVRSNIMIALGDLSIRFPNLIEPWTPNLYARLRDPSREVRKTAGMVMTHLILKDMVKVKGQVSEMAVLLIESDQEISALARNFFNELSNKGNAVYNLLPDIISRLSDPDCGVEEEAFRTIMKQLLSYITKDKQTESLVEKMCHRFRTARTERQWRDLAHCLSLLPFSEKGLRKMQDCFDCYGDKLSDEAVYNSFLTTVAKMRRGAKPELKALIDEFEQKLSRCHNKGLENMDVPEEPSAESDAQPPKAKRPPLASVNVKKGKSEDDFQTPKPPASRKSRRKVAVNFSSDEESDLEAELSEAETPKNPTPIRRTARSRAK

SEQ ID NO: 4346 - protein, 149 aa, Mus musculus
MRFLAATILLLALVAASQAEPLHFKDCGSKVGVIKEVNVSPCPTDPCQLHKGQSYSVNITFTSGTQSQNSTALVHGILEGIRVPFPIPEPDGCKSGINCPIQKDKVYSYLNKLPVKNEYPSIKLVVEWKLEDDKKNNLFCWEIPVQITS

SEQ ID NO: 4347 - protein, 308 aa, Mus musculus
MASSHTVLMRLVASAYSIAQKAGTIVRCVIAEGDLGIVQKTSATDLQTKADRLVQMSICSSLARKFPKLTIIGEEDLPPGEVDQELIEDGQWEEILKQPCPSQYSAIKEEDLVVWVDPLDGTKEYTEGLLDNVTVLIGIAYEGKAIAGIINQPYYNYQAGPDAALGRTIWGVLGLGAFGFQLKEAPAGKHIITTTRSHSNQLVTDCISAMNPDTVLRVGGAGNKIIQLIEGKASAYVFASPGCKKWDTCAPEVILHAVGGKLTDIHGNALQYNKEVKHMNSAGVLAALRNYEYYASHVPESVKNALIP

SEQ ID NO: 4348 - protein, 137 aa, Rattus norvegicus
VHTVFTKKEEKKEWRKTLEPWKLYATVGLLVGMDVLTLAIWQIVDPLHRTIETFAKEEPKEDIDVSILPQLEHCSSKKMNTWLGIFYGYKGLLLLLGIFLAYETKSVSTEKINDHRAVGMAIYNVAVLCLITAPVTM

SEQ ID NO: 4349 - protein, 155 aa, Rattus norvegicus
VHTVFTKKEEKKEWRKTLEPWKLYATVGLLVGMDVLTLAIWQIVDPLHRTIETFAKEEPKEDIDVSILPQLEHCSSKKMNTWLGIFYGYKGLLLLLGIFLAYETKSVSTEKINDHRAVGMAIYNVAVLCLITAPVTMILSSQQDAAFAFASLAIV

SEQ ID NO: 4350 - protein, 137 aa, Rattus norvegicus; identical to SEQ ID NO: 4348

SEQ ID NO: 4351 - protein, 155 aa, Rattus norvegicus; identical to SEQ ID NO: 4349

SEQ ID NO: 4352 - protein, 137 aa, Rattus norvegicus; identical to SEQ ID NO: 4348

SEQ ID NO: 4353 - protein, 155 aa, Rattus norvegicus; identical to SEQ ID NO: 4349

SEQ ID NO: 4354 - protein, 648 aa, Mus musculus
MASVSALTEELESVASELHAIDIQIQELTERRQELLQRKSVLTGKIKQYLEDSSAEASSDLDTSPAAWNKEDFPWFGKVKDVLQNVFKLQKFRPLQLETINVTMARKDIFLVMPTGGGKSLCYQLPALCSDGFTLVICPLISLMEDQLMVLKQLGISATMLNASSSKEHVKWVHAEMVNKNSQLKLIYVTPEKIAKSKMFMSRLEKAYEAGRLTGAAVDEVHCCSQWGHDFRPDYKALGILKRQFPNASLMGLTATATNHVLKDVQKILCVGKCLTFTASFNRPNLFYEVRQKPSSAEDFTEDIVKLINGRYKGQSGIIYCFSQKDSEQITISLQKLGIHAGTYHANMEPEDKTKVHTQWSANELQVVVATVAFGMGIDKPDVRFVIHHSMSKSMENYYQESGRAGRDDSRADCILYYGFGDIFRISSMVVMENVGQQKLYEMVSYCQNVSKCRRVLIAQHFDEVWNADACNKMCDNCCKDVSFEKKNVTQHCRDLIKILKQAEGLNEKLTPLKLIDAWMGKGAAKLRVAGVVAPALPREDLERIVAHALLQQYLKEDYSFTAYATISYLKVGPRACLLSNEAHAVTMQVKKSAQSSVRGALSEARQVEQVDSKGEEQSSGNSQKSKSRLQPSGSKNAGAKKRKLDDA

SEQ ID NO: 4355 - protein, 631 aa, Mus musculus
MASVSALTEELESVASELHAIDIQIQELTERRQELLQRKSVLTGKIKQYLEDSSAEASSDLDTSPAAWNKEDFPWFGKVKDVLQNVFKLQKFRPLQLETINVTMARKDIFLVMPTGGGKSLCYQLPALCSDGFTLVICPLISLMEDQLMVLKQLGISATMLNASSSKEHVKWVHAEMVNKNSQLKLIYVTPEKIAKSKMFMSRLEKAYEAGRLTGAAVDEVHCCSQWGHDFRPDYKALGILKRQFPNASLMGLTATATNHVLKDVQKILCVGKCLTFTASFNRPNLFYEVRQKPSSAEDFTEDIVKLINGRYKGQSGIIYCFSQKDSEQITISLQKLGIHAGTYHANMEPEDKTKVHTQWSANELQVVVATVAFGMGIDKPDVRFVIHHSMSKSMENYYQESGRAGRDDSRADCILYYGFGDIFRISSMVVMENVGQQKLYEMVSYCQNVSKCRRVLIAQHFDEVWNADACNKMCDNCCKDVSFEKKNVTQHCRDLIKILKQAEGLNEKLTPLKLIDAWMGKGAAKLRVAGVVAPALPREDLERIVAHALLQQYLKEDYSFTAYATISYLKVGPRACLLSNEAHAVTMQVKKSAQSSVRGALSEARQVEQVDSKGEEQSSGSHAADTAANV

SEQ ID NO: 4356 - protein, 51 aa, Rattus norvegicus
KMDTDVVVLTTGVLVLITMLPMIPQSGKQHLLDFFDIFGRLSSWCLKKPGH

SEQ ID NO: 4357 - protein, 54 aa, Rattus norvegicus
KMDTDVVVLTTGVLVLITMLPMIPQSGKQHLLDFFDIFGRLSSWCLKKPGHVTE

SEQ ID NO: 4358 - protein, 136 aa, Mus musculus
VQYLVYQMLKGLKYIHSAGIVHRDLKPGNLAVNEDCELKILDFGLARHTDTEMTGYVVTRWYRAPEVILSWMHYNQTVDIWSVGCIMAEMLTGKTLFKGKDYLDQLTQILKVTGVPGAEFVQKLKDKAAKSYIQSL

SEQ ID NO: 4359 - protein, 137 aa, Mus musculus
LVYQMLKGLKYIHSAGIVHRDLKPGNLAVNEDCELKILDFGLARHTDTEMTGYVVTRWYRAPEVILSWMHYNQTVDIWSVGCIMAEMLTGKTLFKGKDYLDQLTQILKVTGVPGAEFVQKLKDKAAKSYIQSLPQSP

SEQ ID NO: 4360 - protein, 382 aa, Mus musculus
MTEFWLISAPGEKTCQQTWEKLHAATTKNNNLAVSSKFNIPDLKVGTLDVLVGLSDELAKLDAFVEGVVKKVAQYMADVLEDSKDKVQENLLASGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMTRLSTDKKKQFGPLVRWLKVNFSEAFIAWIHIKALRVFVESVLRYGLPVNFQAMLLQPNKKSVKKLREVLHELYKHLDSSAAAIIDAPMDIPGLNLSQQEYYPYVYYKIDCNLLEFK

SEQ ID NO: 4361 - protein, 308 aa, Rattus norvegicus
MASSHNVLMRLVASAYSIAQKAGTIVRCVIAEGDLGIVQKTSATDLQTKADRMVQMSICSSLSRKFPKLTIIGEEDLPPGEVDQELIEDGQSEEILKQPCPSQYSAIKEEDLVVWVDPVDGTKEYTEGLLDNVTVLIGIAYEGKAIAGIINQPYYNYQAGPDAVLGRTIWGVLGLGAFGFQLKEAPAGKHIITTTRSHSNKLVTDCIAAMNPDNVLRVGGAGNKIIQLIEGKASAYVFASPGCKKWDTCAPEVILHAVGGKLTDIHGNPLQYDKEVKHMNSAGVLAALRNYEYYASRVPESVKSALIP

SEQ ID NO: 4362 - protein, 197 aa, Mus musculus
ITNAVQQKRPTALAKILGVYRIGYKNSQNNTEKKLDLLVMENLFYGRKMAQVFDLKGSLRNRNVKTDTGKESCDVVLLDENLLKMVRDNPLYIRSHSKSVLRTSIHSDAHFLSSHLIIDYSLLVGRDDTSNELVVGIIDYIRTFTWDKKLEMVVKSTGILGGQGKMPTVVSPELYRTRFCEAMDKYFLMVPDHWTGL

SEQ ID NO: 4363 - protein, 122 aa, Mus musculus
YGRKMAQVFDLKGSLRNRNVKTDTGKESCDVVLLDENLLKMVRDNPLYIRSHSKSVLRTSIHSDAHFLSSHLIIDYSLLVGRDDTSNELVVGIIDYIRTFTWDKKLEMVVKSTGILGGQGKM

SEQ ID NO: 4364 - protein, 197 aa, Mus musculus; identical to SEQ ID NO: 4362

SEQ ID NO: 4365 - protein, 122 aa, Mus musculus; identical to SEQ ID NO: 4363

SEQ ID NO: 4366 - protein, 200 aa, Mus musculus; identical to SEQ ID NO: 510

SEQ ID NO: 4367 - protein, 36 aa, Mus musculus; identical to SEQ ID NO: 511

SEQ ID NO: 4368 - protein, 433 aa, Mus musculus
MASPVAIAAQAGKLLRERALRPLLAVRSQAGHLTPRRWLNLQEYQSKKLMSEHGVRVQRFFVANTAKEALEAAKRLNAKEIVLKAQILAGGRGKGVFNSGLKGGVHLTKDPKVVGELAQQMIGYNLATKQTPKEGVKVNKVMVAEALDISRETYLAILMDRSHNGPVIVGSPQGGVDIEEVAASSPELIFKEQIDIFEGIKDSQAQRMAENLGFLGSLKNQAADQITKLYHLFLKIDATQVEVNPFGETPEGQVVCFDAKINFDDNAEFRQKDIFAMDDKSENEPIENEAARYDLKYIGLDGNIACFVNGAGLAMATCDIIFLNGGKPANFLDLGGGVKEAQVYEAFKLLTSDPKVEAILVNIFGGIVNCAIIANGITKACRELELKVPLVVRLEGTNVQEAQNILKSSGLPITSAVDLEDAAKKAVASVAKK

SEQ ID NO: 4369 - protein, 384 aa, Mus musculus
MSEHGVRVQRFFVANTAKEALEAAKRLNAKEIVLKAQILAGGRGKGVFNSGLKGGVHLTKDPKVVGELAQQMIGYNLATKQTPKEGVKVNKVMVAEALDISRETYLAILMDRSHNGPVIVGSPQGGVDIEEVAASSPELIFKEQIDIFEGIKDSQAQRMAENLGFLGSLKNQAADQITKLYHLFLKIDATQVEVNPFGETPEGQVVCFDAKINFDDNAEFRQKDIFAMDDKSENEPIENEAARYDLKYIGLDGNIACFVNGAGLAMATCDIIFLNGGKPANFLDLGGGVKEAQVYEAFKLLTSDPKVEAILVNIFGGIVNCAIIANGITKACRELELKVPLVVRLEGTNVQEAQNILKSSGLPITSAVDLEDAAKKAVASVAKK

SEQ ID NO: 4370 - protein, 463 aa, Mus musculus
MAASMFYGRQLAAAALRSHRPQTTLRAAAQVLGNSGLFNKHGLQVQQQQQRTLSLHEYLSMELLQEAGVSVPKGFVAKSSDEAYAIAKKLGSKDVVIKAQVLAGGRGKGTFTSGLKGGVKIVFSPEEAKAVSSQMIGQKLITKQTGEKGRICNQVLVCERKYPRREYYFAITMERSFQGPVLIGSAQGGVNIEDVAAENPEAIVKEPIDIVEGIKKEQAVTLAQKMGFPSNIVDSAAENMIKLYNLFLKYDATMVEINPMVEDSDGKVLCMDAKINFDSNSAYRQKKIFDLQDWSQEDERDKEAANADINYIGLDGSIGCLVNGAGLAMATMDIIKLHGGTPANFLDVGGGATVQQVTEAFKLITSDKKVQAILVNIFGGIMRCDVIAQGIVMAVKDLEIRIPVVVRLQGTRVDDAKALIADSGLKILACDDLDEAAKMVVKLSEIVTLAKEAHVDVKFQLPI

SEQ ID NO: 4371 - protein, 148 aa, Brucella abortus; identical to SEQ ID NO: 72

SEQ ID NO: 4372 - protein, 123 aa, Brucella abortus; identical to SEQ ID NO: 73

SEQ ID NO: 4373 - protein, 332 aa, Helicobacter pylori
MAQNLPTIALLATGGTIAGSGVDASLGSYKSGELGVKELLKAIPSLNKIARIQGEQVSNIGSQDMNEEIWFKLAQRAQELLDDSRIQGVVITHGTDTLEESAYFLNLVLHSTKPVVLVGAMRNASSLSADGALNLYYAVSVAVNEKSANKGVLVVMDDTIFRVREVVKTHTTHISTFKALNSGAIGSVYYGKTRYYMQPLRKHTTESEFSLSQLKTPLPKVDIIYTHAGMTPDLFQASLNSHAKGVVIAGVGNGNVSAGFLKAMQEASQMGVVIVRSSRVGSGGVTSGEIDDKAYGFITSDNLNPQKARVLLQLALTKTNDKAKIQEMFEEY

SEQ ID NO: 4374 - protein, 255 aa, Helicobacter pylori
MKIGVFDSGVGGFSVLKSLLKARLFDEIIYYGDSARVPYGTKDPTTIKQFGLEALDFFKPHEIELLIVACNTASALALEEMQKYSKIPIVGVIEPSILAIKRQVEDKNAPILVLGTKATIQSNAYDNALKQQGYLNISHLATSLFVPLIEESILEGELLETCMHYYFTPLEILPEVIILGCTHFPLIAQKIEGYFMGHFALPTPPLLIHSGDAIVEYLQQKYALKNNACTFPKVEFHASGDVIWLERQAKEWLKL

SEQ ID NO: 4375 - protein, 230 aa, Helicobacter pylori
MQKIGILGAMREEITPILELFGVDFEEIPLGGNVFHKGVYHNKEIIVAYSKIGKVHSTLTTTSMILAFGVQKVLFSGVAGSLVKDLKINDLLVATQLVQHDVDLSAFDHPLGFIPESAIFIETSGSLNALAKKIANEQHIALKEGVIASGDQFVHSKERKEFLVSEFKASAVEMEGASVAFVCQKFGVPCCVLRSISDNADEKAGMSFDEFLEKSAHTSAKFLKSMVDEL

SEQ ID NO: 4376 - protein, 341 aa, Arabidopsis thaliana
MFRSMLVRSSASAKQAVIRRSFSSGSVPERKVAILGAAGGIGQPLALLMKLNPLVSSLSLYDIANTPGVAADVGHINTRSEVVGYMGDDNLAKALEGADLVIIPAGVPRKPGMTRDDLFNINAGIVKNLCTAIAKYCPHALINMISNPVNSTVPIAAEIFKKAGMYDEKKLFGVTTLDVVRARTFYAGKANVPVAEVNVPVIGGHAGVTILPLFSQATPQANLSSDILTALTKRTQDGGTEVVEAKAGKGSATLSMAYAGALFADACLKGLNGVPDVIECSYVQSTITELPFFASKVRLGKNGVEEVLDLGPLSDFEKEGLEALKPELKSSIEKGVKFANQ

SEQ ID NO: 4377 - protein, 77 aa, Arabidopsis thaliana
KKTVKFQKSLVIFMSLFLVKHGQAYLVETMNTVQPNIITAIVEHFWIPNLKLIMGSMEVKLTAVAATRLICETPALL

SEQ ID NO: 4378 - protein, 136 aa, Arabidopsis thaliana
VKFQKSLVIFMSLFLVKHGQAYLVETMNTVQPNIITAIVEHFWIPNLKLIMGSMEVKLTAVAATRLICETPALLDPSAAKLWGKMLDSIVTLVSRPEQERVLDEPEMPEISENVGYTAAFVKLHNAGKKEEDPLKD

SEQ ID NO: 4379 - protein, 689 aa, Arabidopsis thaliana
MLRSITLSPTRRFGFPPRCVSFTTIKELILTEENDGSSLHYAASSPCFLLLSKCTNIDSLRQSHGVLTGNGLMGDISIATKLVSLYGFFGYTKDARLVFDQIPEPDFYLWKVMLRCYCLNKESVEVVKLYDLLMKHGFRYDDIVFSKALKACTELQDLDNGKKIHCQLVKVPSFDNVVLTGLLDMYAKCGEIKSAHKVFNDITLRNVVCWTSMIAGYVKNDLCEEGLVLFNRMRENNVLGNEYTYGTLIMACTKLSALHQGKWFHGCLVKSGIELSSCLVTSLLDMYVKCGDISNARRVFNEHSHVDLVMWTAMIVGYTHNGSVNEALSLFQKMKGVEIKPNCVTIASVLSGCGLIENLELGRSVHGLSIKVGIWDTNVANALVHMYAKCYQNRDAKYVFEMESEKDIVAWNSIISGFSQNGSIHEALFLFHRMNSESVTPNGVTVASLFSACASLGSLAVGSSLHAYSVKLGFLASSSVHVGTALLDFYAKCGDPQSARLIFDTIEEKNTITWSAMIGGYGKQGDTIGSLELFEEMLKKQQKPNESTFTSILSACGHTGMVNEGKKYFSSMYKDYNFTPSTKHYTCMVDMLARAGELEQALDIIEKMPIQPDVRCFGAFLHGCGMHSRFDLGEIVIKKMLDLHPDDASYYVLVSNLYASDGRWNQAKEVRNLMKQRGLSKIAGHSTME

SEQ ID NO: 4380 - protein, 87 aa, Arabidopsis thaliana
IVFSKALKACTELQDLDNGKKIHCQLVKVPSFDNVVLTGLLDMYAKCGEIKSAHKVFNDITLRNVVCWTSMIAGYVKNDLCEEGLVL

SEQ ID NO: 4381 - protein, 32 aa, Arabidopsis thaliana
LTGLLDMYAKCGEIKSAHKVFNDITLRNVVCW

SEQ ID NO: 4382 - protein, 230 aa, Arabidopsis thaliana
MYVVESKAGAIGCMILSLCCLGSWPAILTLLERRGRLPQHTFLDFATANLLAAIVIAFSLGEIGKSTFLKPDFTTQLPQDNWPSVLLAVAGGVLLSIGNLATQYAFAFVGLSVTEVITASITVVIGTTLNYFLDNKINKAEILFPGVGCFLIAVFLGAAVHASNAADVKEKLKSLPSEDLYSSIENGEDKPEIEKTDVESQEKLAEKAKAGTAGFYVELENKRAIKVQLQ

SEQ ID NO: 4383 - protein, 184 aa, Arabidopsis thaliana
MYVVESKAGAIGCMILSLCCLGSWPAILTLLERRGRLPQHTFLDFATANLLAAIVIAFSLGEIGKSTFLKPDFTTQLPQDNWPSVLLAVAGGVLLSIGNLATQYAFAFVGLSVTEVITASITVVIGTTLNYFLDNKINKAEILFPGVGCFLIAVFLGAAVHASNAADVKEKLKSLPSEYKAETN

SEQ ID NO: 4384 - protein, 210 aa, Arabidopsis thaliana
MYVVESKAGAIGCMILSLCCLGSWPAILTLLERRGRLPQHTFLDFATANLLAAIVIAFSLGEIGKSTFLKPDFTTQLPQDNWPSVLLAVAGGVLLSIGNLATQYAFAFVGLSVTEVITASITVVIGILPLVCDESKTYVSMVSCVSRLNFIGTTLNYFLDNKINKAEILFPGVGCFLIAVFLGAAVHASNAADVKEKLKSLPSEYKAETN

SEQ ID NO: 4385 - protein, 207 aa, Arabidopsis thaliana
MQQPCVIVGSKYCSPNPVGLAIVRKVMKITDGNFVITSADGKLLFKVKDPLFSLHGKRILLDCSGAKVLTLRGKMMTMHDRWQVFRGGSTEEGALLYTVKRSSMIQLAPKLEVFLANNVEEKICDFKVKGAWLDDSCVVYAGDSDTIIAHMCGKQTMRGFFFGKDHFSVTVDKNVDYAFIASLIVILVEIEKAGFITKMTTQMIIGF

SEQ ID NO: 4386 - protein, 177 aa, Arabidopsis thaliana
MQQPCVIVGSKYCSPNPVGLAIVRKVMKITDGNFVITSADGKLLFKVKDPLFSLHGKRILLDCSGAKVLTLRGKMMTMHDRWQVFRGGSTEEGALLYTVKRSSMIQLAPKLEVFLANNVEEKICDFKVKGAWLDDSCVVYAGDSDTIIAHVNKLSFLIFVLEDSILHVNVYIIYFLN

SEQ ID NO: 4387 - protein, 64 aa, Arabidopsis thaliana
IVRKVMKITDGNFVITSADGKLLFKVKDPLFSLHGKRILLDCSGAKVLTLRGKMMTMHDRWQVF

SEQ ID NO: 4388 - protein, 102 aa, Arabidopsis thaliana
AKVLTLRGKMMTMHDRWQVFRGGSTEEGALLYTVKRSSMIQLAPKLEVFLANNVEEKICDFKVKGAWLDDSCVVYAGDSDTIIAHVNKLSFLIFVLEDSILH

SEQ ID NO: 4389 - protein, 389 aa, Casuarina glauca
MVTVEEVRKAQRAEGPATVLAIGTATPPNCLDQSTYPDYYFRITNSEHKTELKEKFQRMCDKSMIKKRYMYLTEEILKEHPNMCAYMAPSLDARQDMVVVEIPKLGKEAAVKAIKEWGQPKSKITHLVFCTTSGVDMPGADYQLTKLLGLRPSVKRLMMYQQGCFAGGTVLRLAKDLAENNRGARVLVVCSEITAVTFRGPSDTHLDSLVGQALFGDGAAAIIVGADPLPEVEKPLFEVVSTAQTILPDSDGAIDGHLREVGVTFHLLKDVPGLISKNIEKSLVEAFQPLGISDWNSLFWIAHPGGPAILDQVEEKLALKPEKLGATRHVLSEYGNMSSACVLFILDEMRRKSAEKGLKTTGEGLDWGVLFGFGPGLTVETVVLHSLTT

SEQ ID NO: 4390 - protein, 389 aa, Catharanthus roseus
MVNVEEIRNAQRAQGPATVLAIGTSTPSNCVDQSTYPDYYFRITNSEHKTELKEKFKRMCEKSMIKKRYMHLTEEILQENPNICAYMAPSLDARQNIVVVEVPKLGKEAAQKAIKEWGQSKSKITHLVFCTTSGVDMPGADYQLTKLLGLRSSVKRLMMYQQGCFAGGTVLRLAKDLAENNKGARVLVVCSEITAVTFRGPSESHLDSLVGQALFGDGAAAIIVGSDPIPEIERPLFELVSAAQTLLPDSHGAIDGHLREVGLTFHLLKDVPGLISKNIGKALDEAFQPLGISDWNSIFWIAHPGGPAILDQVEEKLGLKPEKLRATRHVLSEYGNMSSACVLFILDEMRKASARDGLSTTGEGLEWGVLFGFGPGLTVETVVLHSVNV

SEQ ID NO: 4391 - protein, 397 aa, Daucus carota
MANHNAEIEEIRKRQRAQGPANILAIGTATPSNCVYQADYPDYYFRITNSEHMSDLKLKFKRMCEKSMIRKRYMHITEEYLKENPNVCAYEAPSLDARQDLVVVEVPRLGKEAAAKAIKEWGHPKSKITHLIFCTTSGVDMPGADYQLTKLLGLRPSVKRFMMYQQGCFAGGTVLRLAKDLAENNTGARVLVVCSEITAVTFRGPSDSHLDSLVGQALFGDGAAAVIVGSDPDLSVERPLFQLISAAQTILPDSDGAIDGHLREVGLTFHLLKDVPGLISKNIEKSLKEAFGPIGISDWNSLFWIAHPGGPAILDQVELKLGLKEEKMRATRQVLSDYGNMSSACVLFILDEMRKKSIEEGKATTGDGLDWGVLFGFGPGLTVETVVLHSVPATITH

SEQ ID NO: 4392 - protein, 389 aa, Daucus carota
MVTVNEFRKAQRAEGPATVLAIGTATPPNCVDQSAYADYYFRITNSEDKPELKEKFRRMCEKSMINTRYMHLTEDLLKQNPSFCEYMASSLDARQDIVVNEVPKLGKEAALRAIKEWGQPKSKITHLIFCTTSGVDMPGADFRLTKLLGLRPSVKRFMMYQQGCFAGGTVLRLAKDLAENNKNARVLVVCSEITVITFRGPNDTHLDSLVGQALFGDGAGAVIVGSDPVIGIEKPLFEIVSAAQTILPDSDGAIDGHLREVGLTFHLLKDVPGLISKNIRKSLVEAFKPLGISDWNSIFWIAHPGGPAILDQVETELSLKPEKLKSTRQVLRDYGNMSSACVLFILDEMRKASAKDGHRTTGEGLDWGVLFGFGPGLTVETVVLHSVPP

SEQ ID NO: 4393 - protein, 496 aa, Arabidopsis thaliana
MSLWYIIVAFVFFSSMIIVRIIRKTKKNLPPGPPRLPIIGNLHQLGSKPHRSMFKLSETYGPLMSLKFGSVSTVVASTPETVKEVLKTFDVECCSRPNMTYPARVTYNLKDLCFSPYSKYWREVRKMTVVELYTAKRVQSFQHTRKEEVAALVDFIKQAASLEKPVNLNKKLMKLSGSVICRVAFGINLQGSKLENTYEEVIQGTVELVGSFAAADYFPVVGRIIDRITGLHSKCEKLFKAMDAFFDQSIKHHLEDEIIKDDIIDLLLKMERGETTLGEFQLTRDHTKGILANILNAGIDTSAQVMTWVMTYLISNPRVLKKAQAEVREVIKHKDDIIEEDIERLQYLKMVIKETFRINPLVPLLIPREASKDVKIGGYNIPKKTWIHVNIWAIHRNPNVWKDPEAFIPERFMDSQIDYKGLNFELLPFGSGRRICPGIGMGMALVHLTLINLLYRFDWKLPEGMKVADVDLEESYGLVCPKKIPLQLIPVLTQWT

SEQ ID NO: 4394 - protein, 577 aa, Arabidopsis thaliana
MRFSSIFRNTPIQFSNRRSSVKLLHSLPRLKPTNSKRFSQKPKLVKTQTLPDPSVYTRDIVSNIYNILKYSNWDSAQEQLPHLGVRWDSHIINRVLKAHPPMQKAWLFFNWAAQIKGFKHDHFTYTTMLDIFGEAGRIQSMYSVFHLMKEKGVLIDTVTYTSLIHWVSSSGDVDGAMRLWEEMRDNGCEPTVVSYTAYMKMLFADGRVEEATEVYKEMLRSRVSPNCHTYTVLMEYLVATGKCEEALDIFFKMQEIGVQPDKAACNILIAKALKFGETSFMTRVLVYMKENGVVLRYPIFVEALETLKAAGESDDLLREVNSHISVESLCSSDIDETPTAEVNDTKNSDDSRVISSVLLMKQNLVAVDILLNQMRDRNIKLDSFVVSAIIETNCDRCRTEGASLAFDYSLEMGIHLKKSAYLALIGNFLRSNELPKVIEVVKEMVKAQHSLGCYQGAMLIHRLGFGRRPRLAADVFDLLPDDQKGVAAYTALMDVYISAGSPEKAMKILREMREREIMPSLGTYDVLLSGLEKTSDFQKEVALLRKEKKSLVASARFRENVHVEDKICDLLFATNLL

SEQ ID NO: 4395 - protein, 265 aa, Arabidopsis thaliana
MALAYDPLFITSDKSLSAFDVASSPPQPMNLTQDELKRIAAYKAVEFVESGMVLGLGTGSTAKHAVDRIGELLRQGKLENIVGIPTSKKTQEQALSLGIPLSDLDAHPVIDLSIDGADEVDPFLNLVKGRGGSLLREKMIEGASKKFVVIVDDSKMVKHIGGSKLALPVEIVPFCWKFTAEKLRSLLEGYGCEANLRLGEKGKAFVTDNGNYIVDMHVEEDMGDLGAVSDAILRLPGVVEHGMFLDMASTVIIAGELGVKIKNKH

SEQ ID NO: 4396 - protein, 70 aa, Arabidopsis thaliana
LKRTCVYDLHHSILGLLFAVLITGVITDSIKVATGRPRPNFYWRCFPDGKELYDALGGVVCHGKAAEVKE

SEQ ID NO: 4397 - protein, 154 aa, Arabidopsis thaliana
KDMMTDLKYPFKDNTVPIWSVPVYAVLLPIIVFVCFYLKRTCVYDLHHSILGLLFAVLITGVITDSIKVATGRPRPNFYWRCFPDGKELYDALGGVVCHGKAAEVKEGHKSFPSGHTSWSFAGLTFLSLYLSGKIKAFNNEGHVAKLCLVIFPL

SEQ ID NO: 4398 - protein, 592 aa, Arabidopsis thaliana
MRRCKNNTDKFSVITMRLLTLLLICTFFFFFSFAYSAESDNETDSVVTREINGTVVESNATSAKPREDSFADMIDRALEKEFPDNDQNEVPDPGSFNNSVADQQAVLETVARVKPKKNETKTKEEKSFFNLDNENGVEDTPRLIDRKDNVFIMSNPKSKYPVLQLDLRLISDLVVVIVSATCGGIAFACAGQPVITGYLLAGSIIGPGGLSFVSEMVQVETVAQFGVIFLLFALGLEFSAAKLRVVRAVAIPGGLLQIFLFMCLSGITASLCGGKLTEGIFVGAFLSMSSTAVVLKFLMERNSISALHGQITVGTLILQDCAVGLLFALLPVLGGTSGVLQGVLSMAKSLAILIAFLGALFVLSRTWVPWFLKLMTSLSSQTNELYQLAAVAFCLLVAWCSDKLGLSLELGSFAAGVMISTTDLAQHTLEQVEPIRNFFAALFLASIGMLIHMHFLWNHVDILLAAVLLVIVIKTVVVAIVVKVFGYNNKTAVLVGMSLAQIGEFAFVLLSRASNLHLIESKLYLLLLGTTALSLVTTPLLFKLIPAVVHLGVLLRWFSPDSSTEIGFKGELYHSESAKRISLMIQGSLHDS

SEQ ID NO: 4399 - protein, 466 aa, Arabidopsis thaliana
MFIAMADFKILLLILILISLFELDLLHFHHDFFSPFPVKIGLLLISIFFYAYSTTRSKPVYLVDFSCHQPTDSCKISSETFFNMAKGAQLYTDETIQFMTRILNRSGLGDDTYSPRCMLTSPPTPSMYEARHESELVIFGALNSLFKKTGIEPREVGIFIVNCSLFNPNPSLSSMIVNRYKLKTDVKTYNLSGMGCSAGAISVDLATNLLKANPNTYAVIVSTENMTLSMYRGNDRSMLVPNCLFRVGGAAVMLSNRSQDRVRSKYELTHIVRTHKGSSDKHYTCAEQKEDSKGIVGVALSKELTVVAGDSLKTNLTALGPLVLPLSEKLRFILFLVKSKLFRLKVSPYVPDFKLCFKHFCIHAGGRALLDAVEKGLGLSEFDLEPSRMTLHRFGNTSSSSLWYELAYVEAKCRVKRGDRVWQLAFGSGFKCNSIVWRALRTIPANESLVGNPWGDSVHKYPVHVT

SEQ ID NO: 4400 - protein, 222 aa, Arabidopsis thaliana
MNKLSNAFSVLAFADEDAPMASSSSTGKQEESVNGSLEDGDYKQPLVWIDLEMTGLNVEVDRILEIACIITNGDLTQSVEGPDLVVRQTKDCLDKMDDWCQTHHGASGLTKKVLLSAITEREAEQKVIEFVKKHVGSGNPLLAGNSVYVDFLFLKKYMPELAALFPHILVDVSSVKALCARWFPIERRKAPAKKNNHRAMDDIRESIKELKYYKKTIFKARR

SEQ ID NO: 4401 - protein, 108 aa, Arabidopsis thaliana
ILEIACIITNGDLTQSVEGPDLVVRQTKDCLDKMDDWCQTHHGASGLTKKVLLSAITEREAEQKVIEFVKKHVGSGNPLLAGNSVYVDFLFLKKYMPELAALFPHILV

SEQ ID NO: 4402 - protein, 469 aa, Gentiana triflora
MEQIQMVKVLEKCQVTPPSDTTDVELSLPVTFFDIPWLHLNKMQSLLFYDFPYPRTHFLDTVIPNLKASLSLTLKHYVPLSGNLLMPIKSGEMPKFQYSRDEGDSITLIVAESDQDFDYLKGHQLVDSNDLHGLFYVMPRVIRTMQDYKVIPLVAVQVTVFPNRGIAVALTAHHSIADAKSFVMFINAWAYINKFGKDADLLSANLLPSFDRSIIKDLYGLEETFWNEMQDVLEMFSRFGSKPPRFNKVRATYVLSLAEIQKLKNKVLNLRGSEPTIRVTTFTMTCGYVWTCMVKSKDDVVSEESSNDENELEYFSFTADCRGLLTPPCPPNYFGNCLASCVAKATHKELVGDKGLLVAVAAIGEAIEKRLHNEKGVLADAKTWLSESNGIPSKRFLGITGSPKFDSYGVDFGWGKPAKFDITSVDYAELIYVIQSRDFEKGVEIGVSLPKIHMDAFAKIFEEGFCSLS

SEQ ID NO: 4403 - protein, 367 aa, Ovis aries
MVPTEATSLILNPSDDYGYDGTPPMEYDTNLTDYFCEKSHVRQFAGHFLPPLYWLVFIVGAVGNSLVILVYWYCTRVKTMTDMFLLNLAIADLLFLTTLPFWAIAAADQWKFQTFMCKVVNSMYKMNFYSCVLLIMCISVDRYIAIAQAMRAQMWRQKRLLYSKMVCFTIWVMAAALCLPELLYSQVKEEHGTAICTVVYSSNESTKLKSAVLTLKVTLGFFLPFVVMACCYAIIIHTLIRAKKSSKHKALKVTITVLTVFVLSQFPHNCVLLVQTIDAYATFISSCALSIKIDICFQVTQTVAFFHSCLNPVLYVFVGERFRRDLVKTLKNLGCISQAQWVSFTRREGSLKLSSMLLETTSGALSF

SEQ ID NO: 4404 - protein, 589 aa, Sus scrofa
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMTQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 4405 - protein, 51 aa, Gallus gallus
GVDGSLQTASFLHLPFLFDSQWHKLMISVETTSVTLFIDCIKVETLNIKPK

SEQ ID NO: 4406 - protein, 102 aa, Saccharomyces cerevisiae
LTLIYLNDLENETLKVFDKIYSTWLVKFMKHASAHIEIFDMVLNEKLFKNSGDEKFAKLFTFLNEFDAVLCKFQVVDSMHTKIFNDTLKYLNVMLFNDLITK

SEQ ID NO: 4407 - protein, 11 aa, Artificial Sequence
  Description of Artificial Sequence: Synthetic peptide
MGSHHHHHHHH

SEQ ID NO: 4408 - protein, 20 aa, Artificial Sequence
  Description of Artificial Sequence: Synthetic peptide
MGSSHHHHHHSSGLVPRGSH

SEQ ID NO: 4409 - protein, 147 aa, Anas platyrhynchos; identical to SEQ ID NO: 608

SEQ ID NO: 4410 - protein, 162 aa, Ovis orientalis; identical to SEQ ID NO: 1557

SEQ ID NO: 4411 - protein, 51 aa, Gallus gallus
LHLPFLFDSQWHKLMISVETTSVTLFIDCIKVETLNIKPKGKISVDGFSVL

SEQ ID NO: 4412 - protein, 52 aa, Saccharomyces cerevisiae
MIHGGVRYLEKAFWEFSKAQLDLVIEALNERKHLINTAPHLCTVLPILIPIY

SEQ ID NO: 4413 - protein, 53 aa, Saccharomyces cerevisiae
LYLEEVSKNLVEINPLKLEVKAKPWFVYTPMHGVGFDIFSTIVKKTLCLVEGK

SEQ ID NO: 4414 - protein, 51 aa, Gallus gallus; identical to SEQ ID NO: 4405

SEQ ID NO: 4415 - protein, 102 aa, Saccharomyces cerevisiae; identical to SEQ ID NO: 4406

SEQ ID NO: 4416 - protein, 106 aa, Sus scrofa
LLNRLADLIERDRTYLAALETLDNGKPYVISYLVDLDMVLKCLRYYAGWADKYHGKTLPIDGDYFSYTRHEPVGVCGQIIPWNFPLLMQAWKLGPALATGNVVVMK

SEQ ID NO: 4417 - protein, 202 aa, Saccharomyces cerevisiae
QVKPKLVNVIRRESGNPDLLELLMDLNCYTLEVTEGYLKKVNVTEVNGDNVLGPIHVITTVVSSLVRNGLLIQSSKFISKVLLTVESIVMSLPKDETMLGGIFWLSNLSRLPAFAANQKTLYEANGGDEKDKLTLIYLNDLENETLKVFDKIYSTWLVKFMKHASAHIEIFDMVLNEKLFKNSGDEKFAKLFTFLNEFDAVL

SEQ ID NO: 4418 - protein, 53 aa, Arabidopsis thaliana; identical to SEQ ID NO: 1916

SEQ ID NO: 4419 - protein, 113 aa, Arabidopsis thaliana; identical to SEQ ID NO: 3555

SEQ ID NO: 4420 - protein, 73 aa, Saccharomyces cerevisiae; identical to SEQ ID NO: 1179

SEQ ID NO: 4421 - protein, 90 aa, Saccharomyces cerevisiae
LVLGALLDTSHKFRNLDKDLCEKCAKCISMIGVLDVTKHEFKRTTYSENEVYDLNDSVQTIKFLIWVINDILVPAFWQSENPSKQLFVAL

SEQ ID NO: 4422 - protein, 70 aa, Saccharomyces cerevisiae
LVLGALLDTSHKFRNLDKDLCEKCAKCISMIGVLDVTKHEFKRTTYSENEVYDLNDSVQTIKFLIWVIND

SEQ ID NO: 4423 - protein, 75 aa, Saccharomyces cerevisiae
TLVLGALLDTSHKFRNLDKDLCEKCAKCISMIGVLDVTKHEFKRTTYSENEVYDLNDSVQTIKFLIWVINDILVP

SEQ ID NO: 4424 - protein, 76 aa, Saccharomyces cerevisiae
LVLGALLDTSHKFRNLDKDLCEKCAKCISMIGVLDVTKHEFKRTTYSENEVYDLNDSVQTIKFLIWVINDILVPAF

SEQ ID NO: 4425 - protein, 74 aa, Saccharomyces cerevisiae
ITLVLGALLDTSHKFRNLDKDLCEKCAKCISMIGVLDVTKHEFKRTTYSENEVYDLNDSVQTIKFLIWVINDIL

SEQ ID NO: 4426 - protein, 76 aa, Saccharomyces cerevisiae
SDITLVLGALLDTSHKFRNLDKDLCEKCAKCISMIGVLDVTKHEFKRTTYSENEVYDLNDSVQTIKFLIWVINDIL

SEQ ID NO: 4427 - protein, 386 aa, Gallus gallus; identical to SEQ ID NO: 585

SEQ ID NO: 4428 - protein, 178 aa, Bos taurus; identical to SEQ ID NO: 627

SEQ ID NO: 4429 - protein, 147 aa, Saccharomyces cerevisiae
MSSNLTEEQIAEFKEAFALFDKDNNGSISSSELATVMRSLGLSPSEAEVNDLMNEIDVDGNHQIEFSEFLALMSRQLKSNDSEQELLEAFKVFDKNGDGLISAAELKHVLTSIGEKLTDAEVDDMLREVSDGSGEINIQQFAALLSK

SEQ ID NO: 4430 - protein, 20 aa, Artificial Sequence
  Description of Artificial Sequence: Synthetic peptide
MGSSHHHHHHSSGLVPRGSH

SEQ ID NO: 4431 - protein, 11 aa, Artificial Sequence
  Description of Artificial Sequence: Synthetic peptide
MGSHHHHHHHH

SEQ ID NO: 4432 - protein, 4 aa, Saccharomyces cerevisiae
LALA

SEQ ID NO: 4433 - protein, 4 aa, Saccharomyces cerevisiae
LLLD

SEQ ID NO: 4434 - protein, 4 aa, Saccharomyces cerevisiae
PSEA

SEQ ID NO: 4435 - protein, 4 aa, Saccharomyces cerevisiae
IAEF

SEQ ID NO: 4436 - protein, 4 aa, Saccharomyces cerevisiae
IQQF

SEQ ID NO: 4437 - protein, 4 aa, Saccharomyces cerevisiae
YDKL

SEQ ID NO: 4438 - protein, 4 aa, Saccharomyces cerevisiae
AEFK

SEQ ID NO: 4439 - protein, 5 aa, Saccharomyces cerevisiae
SNLTE

SEQ ID NO: 4440 - protein, 4 aa, Saccharomyces cerevisiae
LKHV

SEQ ID NO: 4441 - protein, 5 aa, Saccharomyces cerevisiae
ELLEA

SEQ ID NO: 4442 - protein, 5 aa, Saccharomyces cerevisiae
SSSEL

SEQ ID NO: 4443 - protein, 5 aa, Saccharomyces cerevisiae
EELAL

SEQ ID NO: 4444 - protein, 4 aa, Saccharomyces cerevisiae
FKVF

SEQ ID NO: 4445 - protein, 5 aa, Saccharomyces cerevisiae
DDLLL

SEQ ID NO: 4446 - protein, 5 aa, Saccharomyces cerevisiae
AELKH

SEQ ID NO: 4447 - protein, 5 aa, Saccharomyces cerevisiae
LAYDK

SEQ ID NO: 4448 - protein, 5 aa, Saccharomyces cerevisiae
LKHVL

SEQ ID NO: 4449 - protein, 5 aa, Saccharomyces cerevisiae
TKTRL

SEQ ID NO: 4450 - protein, 5 aa, Saccharomyces cerevisiae
FKEAF

SEQ ID NO: 4451 - protein, 5 aa, Saccharomyces cerevisiae
DLDHQ

SEQ ID NO: 4452 - protein, 7 aa, Saccharomyces cerevisiae
NGSISSS

SEQ ID NO: 4453 - protein, 6 aa, Saccharomyces cerevisiae
GTLENL

SEQ ID NO: 4454 - protein, 7 aa, Saccharomyces cerevisiae
SLGLSPS

SEQ ID NO: 4455 - protein, 6 aa, Saccharomyces cerevisiae
EKLTDA

SEQ ID NO: 4456 - protein, 6 aa, Saccharomyces cerevisiae
GEKLTD

SEQ ID NO: 4457 - protein, 6 aa, Saccharomyces cerevisiae
AEVDDM

SEQ ID NO: 4458 - protein, 6 aa, Saccharomyces cerevisiae
ELATVM

SEQ ID NO: 4459 - protein, 6 aa, Saccharomyces cerevisiae
LDDLLL

SEQ ID NO: 4460 - protein, 7 aa, Saccharomyces cerevisiae
GSGEINI

SEQ ID NO: 4461 - protein, 6 aa, Saccharomyces cerevisiae
LDLDHQ

SEQ ID NO: 4462 - protein, 7 aa, Saccharomyces cerevisiae
RSLGLSP

SEQ ID NO: 4463 - protein, 6 aa, Saccharomyces cerevisiae
DLKKKL

SEQ ID NO: 4464 - protein, 6 aa, Saccharomyces cerevisiae
ELKHVL

SEQ ID NO: 4465 - protein, 6 aa, Saccharomyces cerevisiae
KTKTRL

SEQ ID NO: 4466 - protein, 7 aa, Saccharomyces cerevisiae
KLTDAEV

SEQ ID NO: 4467 - protein, 6 aa, Saccharomyces cerevisiae
SQRLEE

SEQ ID NO: 4468 - protein, 6 aa, Saccharomyces cerevisiae
FKVFDK

SEQ ID NO: 4469 - protein, 7 aa, Saccharomyces cerevisiae
AEVDDML

SEQ ID NO: 4470 - protein, 7 aa, Saccharomyces cerevisiae
AEVDDML

SEQ ID NO: 4471 - protein, 7 aa, Saccharomyces cerevisiae
QQELDDL

SEQ ID NO: 4472 - protein, 7 aa, Saccharomyces cerevisiae
DAEVDDM

SEQ ID NO: 4473 - protein, 7 aa, Saccharomyces cerevisiae
LEKTKTR

SEQ ID NO: 4474 - protein, 7 aa, Saccharomyces cerevisiae
AELKHVL

SEQ ID NO: 4475 - protein, 7 aa, Saccharomyces cerevisiae
LEKTKTR

SEQ ID NO: 4476 - protein, 8 aa, Saccharomyces cerevisiae
HVLTSIGE

SEQ ID NO: 4477 - protein, 8 aa, Saccharomyces cerevisiae
GTLENLEE

SEQ ID NO: 4478 - protein, 8 aa, Saccharomyces cerevisiae
SIGEKLTD

SEQ ID NO: 4479 - protein, 8 aa, Saccharomyces cerevisiae
QQELDDLL

SEQ ID NO: 4480 - protein, 9 aa, Saccharomyces cerevisiae
RSLGLSPSE

SEQ ID NO: 4481 - protein, 10 aa, Saccharomyces cerevisiae
KLEKTKTRLQ

SEQ ID NO: 4482 - protein, 9 aa, Saccharomyces cerevisiae
VLTSIGEKL

SEQ ID NO: 4483 - protein, 11 aa, Saccharomyces cerevisiae
SRQLKSNDSEQ

SEQ ID NO: 4484 - protein, 9 aa, Saccharomyces cerevisiae
TSIGEKLTD

SEQ ID NO: 4485 - protein, 11 aa, Saccharomyces cerevisiae
EKTKTRLQQEL

SEQ ID NO: 4486 - protein, 9 aa, Saccharomyces cerevisiae
HVLTSIGEK

SEQ ID NO: 4487 - protein, 11 aa, Saccharomyces cerevisiae
YDKLEKTKTRL

SEQ ID NO: 4488 - protein, 9 aa, Saccharomyces cerevisiae
AELKHVLTS

SEQ ID NO: 4489 - protein, 13 aa, Saccharomyces cerevisiae
LAYDKLEKTKTRL

SEQ ID NO: 4490 - protein, 10 aa, Saccharomyces cerevisiae
RSLGLSPSEA

SEQ ID NO: 4491 - protein, 13 aa, Saccharomyces cerevisiae
EELKKKLLKDLEL

SEQ ID NO: 4492 - protein, 10 aa, Saccharomyces cerevisiae
SSNLTEEQIA

SEQ ID NO: 4493 - protein, 14 aa, Saccharomyces cerevisiae
EELKKKLLKDLELL

SEQ ID NO: 4494 - protein, 11 aa, Saccharomyces cerevisiae
RSLGLSPSEAE

SEQ ID NO: 4495 - protein, 16 aa, Saccharomyces cerevisiae
AELKHVLTSIGEKLTD

SEQ ID NO: 4496 - protein, 13 aa, Saccharomyces cerevisiae
KVFDKNGDGLISA

SEQ ID NO: 4497 - protein, 15 aa, Saccharomyces cerevisiae
MGSHHHHHHHHSSNL

SEQ ID NO: 4498 - protein, 14 aa, Saccharomyces cerevisiae
FDKDNNGSISSSEL

SEQ ID NO: 4499 - protein, 16 aa, Saccharomyces cerevisiae
LREVSDGSGEINIQQF

SEQ ID NO: 4500 - protein, 14 aa, Saccharomyces cerevisiae
REVSDGSGEINIQQ

SEQ ID NO: 4501 - protein, 17 aa, Saccharomyces cerevisiae
AAELKHVLTSIGEKLTD

SEQ ID NO: 4502 - protein, 13 aa, Saccharomyces cerevisiae
DVDGNHQIEFSEF

SEQ ID NO: 4503 - protein, 18 aa, Saccharomyces cerevisiae
AELKHVLTSIGEKLTDAE

SEQ ID NO: 4504 - protein, 15 aa, Saccharomyces cerevisiae
LREVSDGSGEINIQQ

SEQ ID NO: 4505 - protein, 16 aa, Saccharomyces cerevisiae
AYDKLEKTKTRLQQEL

SEQ ID NO: 4506 - protein, 15 aa, Saccharomyces cerevisiae
REVSDGSGEINIQQF

SEQ ID NO: 4507 - protein, 19 aa, Saccharomyces cerevisiae
AAELKHVLTSIGEKLTDAE

SEQ ID NO: 4508 - protein, 21 aa, Saccharomyces cerevisiae
LREVSDGSGEINIQQFAALLS

SEQ ID NO: 4509 - protein, 17 aa, Saccharomyces cerevisiae
LENLEELKKKLLKDLEL

SEQ ID NO: 4510 - protein, 17 aa, Saccharomyces cerevisiae
KLEKTKTRLQQELDDLL

SEQ ID NO: 4511 - protein, 18 aa, Saccharomyces cerevisiae
DKLEKTKTRLQQELDDLL

SEQ ID NO: 4512 - protein, 20 aa, Saccharomyces cerevisiae
LAYDKLEKTKTRLQQELDDL

SEQ ID NO: 4513 - protein, 22 aa, Saccharomyces cerevisiae
LALAYDKLEKTKTRLQQELDDL

SEQ ID NO: 4514 - protein, 4 aa, Saccharomyces cerevisiae
INDI

SEQ ID NO: 4515 - protein, 4 aa, Saccharomyces cerevisiae
HLVL

SEQ ID NO: 4516 - protein, 4 aa, Saccharomyces cerevisiae
IGVL

SEQ ID NO: 4517 - protein, 4 aa, Saccharomyces cerevisiae
TIKF

SEQ ID NO: 4518 - protein, 4 aa, Saccharomyces cerevisiae
TIKF

SEQ ID NO: 4519 - protein, 5 aa, Saccharomyces cerevisiae
IGVLD

SEQ ID NO: 4520 - protein, 4 aa, Saccharomyces cerevisiae
TIKF

SEQ ID NO: 4521 - protein, 4 aa, Saccharomyces cerevisiae
RNLD

SEQ ID NO: 4522 - protein, 5 aa, Saccharomyces cerevisiae
EVYDL

SEQ ID NO: 4523 - protein, 6 aa, Saccharomyces cerevisiae
IGVLDV

SEQ ID NO: 4524 - protein, 6 aa, Saccharomyces cerevisiae
LNDSVQ

SEQ ID NO: 4525 - protein, 5 aa, Saccharomyces cerevisiae
QTIKF

SEQ ID NO: 4526 - protein, 6 aa, Saccharomyces cerevisiae
IWVIND

SEQ ID NO: 4527 - protein, 6 aa, Saccharomyces cerevisiae
VQTIKF

SEQ ID NO: 4528 - protein, 7 aa, Saccharomyces cerevisiae
DLNDSVQ

SEQ ID NO: 4529 - protein, 7 aa, Saccharomyces cerevisiae
SVQTIKF

SEQ ID NO: 4530 - protein, 7 aa, Saccharomyces cerevisiae
SVQTIKF

SEQ ID NO: 4531 - protein, 12 aa, Saccharomyces cerevisiae
KCAKCISMIGVL

SEQ ID NO: 4532 - protein, 10 aa, Saccharomyces cerevisiae
HHLVLGALLD

SEQ ID NO: 4533 - protein, 12 aa, Saccharomyces cerevisiae
EKCAKCISMIGV

SEQ ID NO: 4534 - protein, 9 aa, Saccharomyces cerevisiae
HHHHHHLVL

SEQ ID NO: 4535 - protein, 10 aa, Saccharomyces cerevisiae
HEFKRTTYSE

SEQ ID NO: 4536 - protein, 11 aa, Saccharomyces cerevisiae
HHHHHHHHLVL

SEQ ID NO: 4537 - protein, 11 aa, Saccharomyces cerevisiae
SHKFRNLDKDL

SEQ ID NO: 4538 - protein, 12 aa, Saccharomyces cerevisiae
DVTKHEFKRTTY

SEQ ID NO: 4539 - protein, 13 aa, Saccharomyces cerevisiae
ISMIGVLDVTKHE

SEQ ID NO: 4540 - protein, 12 aa, Saccharomyces cerevisiae
SHHHHHHHHLVL

SEQ ID NO: 4541 - protein, 13 aa, Saccharomyces cerevisiae
TKHEFKRTTYSEN

SEQ ID NO: 4542 - protein, 14 aa, Saccharomyces cerevisiae
GSHHHHHHHHLVLG

SEQ ID NO: 4543 - protein, 14 aa, Saccharomyces cerevisiae
MGSHHHHHHHHLVL

SEQ ID NO: 4544 - protein, 14 aa, Saccharomyces cerevisiae
KRTTYSENEVYDLN

The invention claimed is:

1. A formulation comprising a recombinant nutritive protein, wherein the nutritive protein has an aqueous solubility at pH 7 of at least 50 g/L, and the nutritive protein is present in an amount of at least about 1 g, and wherein the nutritive protein comprises a polypeptide sequence having an amino acid distribution characterized by a Euclidean distance of less than 0.117 from a target amino acid distribution of 60% essential amino acids and 40% non-essential amino acids.

2. The formulation of claim 1, comprising the nutritive protein or a plurality of nutritive proteins in an amount less than 58 grams of protein per 70 kg of body weight that is sufficient to provide minimum amino acid intake values when consumed in one or more doses by a human subject at least once daily, and wherein the polypeptide sequence is essential amino acid complete.

3. The formulation of claim 1, wherein the nutritive protein accounts for at least 5% of a protein intake of 1.5 g/kg of body weight per day, and/or wherein the nutritive protein accounts for at least 5% of the subject's total caloric intake per day.

4. The formulation of claim 1, wherein the nutritive protein is characterized by a simulated gastric digestion half-life of less than 60 minutes.

5. The formulation of claim 1, wherein the polypeptide sequence has an amino acid distribution characterized by a Euclidean distance of less than 0.0716 from a target amino acid distribution of 60% essential amino acids and 40% non-essential amino acids.

6. The formulation of claim 1, wherein the polypeptide sequence is characterized by a weight ratio of essential amino acids to total amino acids present in the polypeptide sequence that is higher than the weight ratio of essential amino acids to total amino acids present in naturally-occurring reference protein selected from the group consisting of SEQ ID NOs 574, 585, 619, 621, 623, 625, 627, 631, 633, 635, 646, 648, 655, 789, 791, 822, 1010, or 1588, or from a reference protein fragment selected from SEQ ID NOs 575, 586, 620, 622, 624, 626, 628, 632, 634, 636, 647, 649, 656, 790, 792, 823, 1011, or 1589.

7. The formulation of claim 1, wherein the polypeptide sequence comprises a histidine target percentage of about 1.5% to about 5.4%, an isoleucine target percentage of about 3% to about 10.8%, a leucine target percentage of about 5.9% to about 21.3%, a lysine target percentage of about 4.5% to about 16.2%, a sulfur-containing amino acid target percentage of about 2.2% to about 7.9%, an aromatic amino acid target percentage of about 3.8% to about 13.7%, a threonine target percentage of about 2.3% to about 8.3%, a tryptophan target percentage of about 0.6% to about 2.2%, a valine target percentage of about 3.9% to about 14.1%, or a combination thereof.

8. The formulation of claim 1, wherein the polypeptide sequence comprises an alanine target percentage of about 1.90% to about 9.49%, an arginine target percentage of about 0.37% to about 1.87%, an asparagine target percentage of about 0.6% to about 3.82%, an aspartic acid target percentage of about 1.45% to about 7.27%, a glutamine-containing amino acid target percentage of about 1.15% to about 5.74%, a glutamic acid target percentage of about 1.77% to about 8.87%, a glycine target percentage of about 0.74% to about 3.68%, a proline target percentage of about 0.82% to about 4.12%, a serine target percentage of about 1.03% to about 5.14%, or a combination thereof.

9. The formulation of claim 1, wherein the nutritive protein is produced by a microorganism.

10. The formulation of claim 1, wherein the polypeptide sequence is selected from:
  A) an amino acid sequence comprising the amino acid sequence of a protein listed in list 1;
  B) an amino acid sequence comprising a modified derivative of the amino acid sequence of a protein listed in list 1;
  C) an amino acid sequence comprising a mutein of the amino acid sequence of a protein listed in list 1;
  D) an amino acid sequence comprising a fragment of at least 20 amino acids of the amino acid sequence of a protein listed in list 1;
  E) an amino acid sequence comprising a modified derivative of a fragment of at least 20 amino acids of the amino acid sequence of a protein listed in list 1;
  F) an amino acid sequence comprising a mutein of a fragment of at least 20 amino acids of the amino acid sequence of a protein listed in list 1;
  G) an amino acid sequence comprising the amino acid sequence of a fragment listed in list 2;
  H) an amino acid sequence comprising a modified derivative of the amino acid sequence of a fragment listed in list 2; and
  I) an amino acid sequence comprising a mutein of the amino acid sequence of a fragment listed in list 2,
  wherein list 1 consists of SEQ ID NOs 30, 114, 136, 221, 224, 227, 232-233, 254-259, 266, 272, 338, 356, 361-362, 365, 407, 412-413, 428, 451, 467, 473, 477-479, 524, 532, 537, 544, 565, 577, 581, 602, 607-608, 639, 670, 683, 703, 711, 765, 776, 814, 844, 928, 935, 966, 1004, 1017, 1046, 1072, 1076, 1095, 1107, 1117, 1123, 1143, 1176, 1184, 1217, 1221, 1224, 1262, 1305, 1362, 1379-1380, 1391, 1420, 1440, 1445-1446, 1453, 1470, 1487, 1522, 1639, 1678, 1705-1706, 1739-1740, 1747, 1753, 1763, 1771, 1834, 1839, 1843, 1871, 1890, 1893, 1914, 1997, 2009, 2103, 2112, 2122-2123, 2149, 2163, 2180, 2183, 2207-2208, 2215, 2218, 2234, 2242, 2244, 2246-2247, 2251, 2309-2310, 2313, 2319, 2324, 2330, 2338-2339, 2343, 2475, 2485, 2495-2496, 2518, 2522, 2527, 2530, 2690, 2695, 2701, 2714, 2796, 2798, 2884, 2898, 3019, 3097, 3100, 3107, 3161, 3294, 3297, 3306, 3315, 3357, 3366, 3403, 3453, 3461, 3507, 3539-3540, 3544, 3607, 3646, 3657, 3665, 3786, 3797, 3812-3813, 3815, 3830, 3838, 3872, 3920, 3923, 3929, 3942, 3947, 3959-3960, 3986, 3998-4001, 4003-4004, 4022, 4105, 4119, 4130, 4154-4155, 4161, 4170, 4176, 4192, 4197-4198, 4225, 4233, 4309, 4313-4314, 4320-4321, 4386, and 4393-4394, and wherein list 2 consists of SEQ ID NOs 3, 31, 45, 54, 62, 87-89, 120, 185, 194-195, 222-223, 251, 263, 267-269, 274, 324, 328, 342, 344, 357, 415, 421, 469, 475, 481, 484, 486, 494, 496, 534, 538, 666, 709, 762, 798, 852, 866-867, 985, 997, 1005, 1054, 1071, 1110-1111, 1119, 1159, 1166, 1182, 1185, 1187, 1192, 1197-1198, 1203-1204, 1207, 1213, 1229-1230, 1234, 1274-1275, 1317, 1323, 1325, 1335, 1366, 1421, 1433, 1441, 1468, 1625, 1628, 1688-1689, 1773, 1776, 1781, 1814, 1822, 1827, 1832, 1837, 1867, 1882, 1909, 1919, 1944, 1953, 1959, 1995, 2003, 2016-2017, 2062-2063, 2065, 2079, 2101, 2108, 2110-2111, 2118, 2131, 2156, 2160, 2171, 2175, 2185, 2202, 2235, 2318, 2466-2468, 2525, 2565, 2693, 2697, 2699, 2702, 2715, 2799, 2910, 2978-2979, 3101, 3163, 3173, 3299-3300, 3302, 3351, 3361, 3370, 3372, 3445, 3450, 3454, 3513-3514, 3566, 3569, 3589-3591, 3594-3595, 3605-3606, 3677, 3788, 3792-3793, 3806-3807, 3816, 3825, 3835-3836, 3844, 3855, 3867, 3874, 3882, 3884, 3911, 3919, 3925-3926, 3955-3956, 3962, 3967-3968, 3974-3976, 3981, 3983-3984, 4011-4012, 4024-4026, 4104, 4107, 4109, 4132, 4150, 4162-4163, 4173-4174, 4178-4179, 4189-4190, 4194, 4199-4200, 4212, 4229, 4238, 4334, 4342-4343, 4388, and 4401.

11. The formulation of claim 1, wherein the nutritive protein exhibits no detectable aggregation at 95° C.

12. The formulation of claim 1, wherein the polypeptide sequence does not comprise N-linked glycosylation or O-linked glycosylation.

* * * * *